US010683503B2

(12) United States Patent
Aznarez et al.

(10) Patent No.: US 10,683,503 B2
(45) Date of Patent: Jun. 16, 2020

(54) ANTISENSE OLIGOMERS FOR TREATMENT OF CONDITIONS AND DISEASES

(71) Applicant: Stoke Therapeutics, Inc., Bedford, MA (US)

(72) Inventors: Isabel Aznarez, Boston, MA (US); Zhou Han, Natick, MA (US)

(73) Assignee: Stoke Therapeutics, Inc., Bedford, MA (US)

( * ) Notice: Subject to any disclaimer, the term of this patent is extended or adjusted under 35 U.S.C. 154(b) by 0 days.

(21) Appl. No.: 16/561,960

(22) Filed: Sep. 5, 2019

(65) Prior Publication Data

US 2020/0024606 A1 Jan. 23, 2020

Related U.S. Application Data

(63) Continuation of application No. PCT/US2018/048031, filed on Aug. 24, 2018.

(60) Provisional application No. 62/671,745, filed on May 15, 2018, provisional application No. 62/667,356, filed on May 4, 2018, provisional application No. 62/575,901, filed on Oct. 23, 2017, provisional application No. 62/550,462, filed on Aug. 25, 2017.

(51) Int. Cl.
| | |
|---|---|
| *C12N 15/113* | (2010.01) |
| *A61P 25/12* | (2006.01) |
| *A61K 9/00* | (2006.01) |
| *A61P 25/00* | (2006.01) |

(52) U.S. Cl.
CPC .......... *C12N 15/113* (2013.01); *A61K 9/0019* (2013.01); *A61K 9/0085* (2013.01); *A61P 25/00* (2018.01); *A61P 25/12* (2018.01); *C12N 15/1138* (2013.01); *C12N 2310/11* (2013.01); *C12N 2310/321* (2013.01); *C12N 2320/32* (2013.01); *C12N 2320/35* (2013.01)

(58) Field of Classification Search
CPC .............. C12N 15/113; C12N 2310/11; C12N 2310/3525
See application file for complete search history.

(56) References Cited

U.S. PATENT DOCUMENTS

| | | | |
|---|---|---|---|
| 4,866,042 A | 9/1989 | Neuwelt | |
| 5,151,510 A | 9/1992 | Stec et al. | |
| 5,656,612 A | 8/1997 | Monia | |
| 5,665,593 A | 9/1997 | Kole et al. | |
| 5,914,396 A | 6/1999 | Cook et al. | |
| 5,916,808 A | 6/1999 | Kole et al. | |
| 5,976,879 A | 11/1999 | Kole et al. | |
| 6,083,482 A | 7/2000 | Wang | |
| 6,166,197 A | 12/2000 | Cook et al. | |
| 6,210,892 B1 | 4/2001 | Bennett et al. | |
| 6,294,520 B1 | 9/2001 | Naito | |
| 6,383,752 B1 | 5/2002 | Agrawal et al. | |
| 6,436,657 B1 | 8/2002 | Famodu et al. | |
| 6,451,991 B1 | 9/2002 | Martin et al. | |
| 6,485,960 B1 | 11/2002 | Harris et al. | |
| 6,531,591 B1 | 3/2003 | Fensholdt | |
| 6,573,073 B2 | 6/2003 | Harris | |
| 6,605,611 B2 | 8/2003 | Simmonds et al. | |
| 6,632,427 B1 | 10/2003 | Finiels et al. | |
| 6,639,059 B1 | 10/2003 | Kochkine et al. | |
| 6,670,461 B1 | 12/2003 | Wengel et al. | |
| 6,677,445 B1 | 1/2004 | Innis et al. | |
| 6,734,291 B2 | 5/2004 | Kochkine et al. | |
| 6,756,523 B1 | 6/2004 | Kahn et al. | |
| 6,770,748 B2 | 8/2004 | Imanishi et al. | |
| 6,794,499 B2 | 9/2004 | Wengel et al. | |
| 6,846,921 B2 | 1/2005 | Innis et al. | |
| 6,936,589 B2 | 8/2005 | Naito | |
| 6,963,589 B1 | 11/2005 | Sugata et al. | |
| 6,998,484 B2 | 2/2006 | Koch et al. | |
| 7,015,315 B1 | 3/2006 | Cook et al. | |
| 7,034,133 B2 | 4/2006 | Wengel et al. | |
| 7,053,199 B2 | 5/2006 | Imanishi et al. | |
| 7,053,207 B2 | 5/2006 | Wengel | |
| 7,060,809 B2 | 6/2006 | Wengel et al. | |
| 7,071,324 B2 | 7/2006 | Preparata et al. | |
| 7,084,125 B2 | 8/2006 | Wengel | |
| 7,101,993 B1 | 9/2006 | Cook et al. | |
| 7,169,594 B2 | 1/2007 | Guan | |
| 7,214,783 B2 | 5/2007 | Jeon et al. | |

(Continued)

FOREIGN PATENT DOCUMENTS

| | | |
|---|---|---|
| CN | 103667438 A | 3/2014 |
| EP | 0549615 A1 | 7/1993 |
| EP | 1201678 B1 | 9/2004 |
| EP | 1409497 B1 | 1/2005 |
| EP | 1007714 B1 | 12/2005 |
| EP | 1334109 B1 | 5/2006 |
| EP | 1178999 B1 | 3/2007 |
| EP | 1203827 B1 | 5/2007 |
| EP | 1501848 B1 | 8/2007 |
| EP | 1569661 B1 | 9/2009 |

(Continued)

OTHER PUBLICATIONS

Escayg et al. Epilepsia 51:1650-1658 (Year: 2011).*
Ogiwara et al. The journal of neuroscience 27:5903-5914 (Year: 2007).*
Aartsma-Rus, et al. Antisense-mediated exon skipping: a versatile tool with therapeutic and research applications.RNA. Oct. 2007;13(10):1609-24. Epub Aug. 7, 2007.

(Continued)

*Primary Examiner* — Brian Whiteman
(74) *Attorney, Agent, or Firm* — Wilson Sonsini Goodrich & Rosati

(57) ABSTRACT

Alternative splicing events in SCN1A gene can lead to non-productive mRNA transcripts which in turn can lead to aberrant protein expression, and therapeutic agents which can target the alternative splicing events in SCN1A gene can modulate the expression level of functional proteins in Dravet Syndrome patients and/or inhibit aberrant protein expression. Such therapeutic agents can be used to treat a condition caused by SCN1A, SCN8A or SCN5A protein deficiency.

62 Claims, 22 Drawing Sheets

Specification includes a Sequence Listing.

(56) References Cited

U.S. PATENT DOCUMENTS

| | | |
|---|---|---|
| 7,217,805 B2 | 5/2007 | Imanishi et al. |
| 7,314,923 B2 | 1/2008 | Kaneko et al. |
| 7,335,765 B2 | 2/2008 | Kaneko et al. |
| 7,368,549 B2 | 5/2008 | Dempcy et al. |
| 7,399,845 B2 | 7/2008 | Seth et al. |
| 7,432,249 B2 | 10/2008 | Crooke |
| 7,432,250 B2 | 10/2008 | Crooke |
| 7,547,684 B2 | 6/2009 | Seth et al. |
| 7,553,644 B2 | 6/2009 | Germino et al. |
| 7,569,575 B2 | 8/2009 | Soerensen et al. |
| 7,569,686 B1 | 8/2009 | Bhat et al. |
| 7,572,582 B2 | 8/2009 | Wengel et al. |
| 7,595,304 B2 | 9/2009 | Zhao et al. |
| 7,615,619 B2 | 11/2009 | Imanishi et al. |
| 7,662,946 B2 | 2/2010 | Ginsburg et al. |
| 7,662,948 B2 | 2/2010 | Kurreck et al. |
| 7,666,854 B2 | 2/2010 | Seth et al. |
| 7,687,617 B2 | 3/2010 | Thrue et al. |
| 7,696,345 B2 | 4/2010 | Allerson et al. |
| 7,741,457 B2 | 6/2010 | Seth et al. |
| 7,750,131 B2 | 7/2010 | Seth et al. |
| 7,816,333 B2 | 10/2010 | Kaneko et al. |
| 7,846,686 B2 | 12/2010 | Kramer |
| 7,951,934 B2 | 5/2011 | Freier |
| 7,994,145 B2 | 8/2011 | Imanishi et al. |
| 8,022,193 B2 | 9/2011 | Seth et al. |
| 8,030,467 B2 | 10/2011 | Seth et al. |
| 8,048,998 B2 | 11/2011 | Rasmussen et al. |
| 8,067,569 B2 | 11/2011 | Iversen et al. |
| 8,084,458 B2 | 12/2011 | Soerensen et al. |
| 8,088,746 B2 | 1/2012 | Seth et al. |
| 8,110,674 B2 | 2/2012 | Manoharan et al. |
| 8,124,745 B2 | 2/2012 | Allerson et al. |
| 8,129,515 B2 | 3/2012 | Esau et al. |
| 8,168,605 B2 | 5/2012 | Zhao et al. |
| 8,258,109 B2 | 9/2012 | Bennett et al. |
| 8,268,980 B2 | 9/2012 | Seth et al. |
| 8,278,036 B2 | 10/2012 | Kariko et al. |
| 8,278,283 B2 | 10/2012 | Seth et al. |
| 8,278,425 B2 | 10/2012 | Prakash et al. |
| 8,278,426 B2 | 10/2012 | Seth et al. |
| 8,293,684 B2 | 10/2012 | Mouritzen et al. |
| 8,361,979 B2 | 1/2013 | Aartsma-Rus et al. |
| 8,383,792 B2 | 2/2013 | Okamoto et al. |
| 8,394,947 B2 | 3/2013 | Bhat et al. |
| 8,415,465 B2 | 4/2013 | Freier |
| 8,436,163 B2 | 5/2013 | Iversen et al. |
| 8,450,467 B2 | 5/2013 | Manoharan et al. |
| 8,461,124 B2 | 6/2013 | Chattopadhyaya |
| 8,492,390 B2 | 7/2013 | Detlef et al. |
| 8,501,703 B2 | 8/2013 | Bennett et al. |
| 8,501,805 B2 | 8/2013 | Seth et al. |
| 8,518,908 B2 | 8/2013 | Hrdlicka et al. |
| 8,530,640 B2 | 9/2013 | Seth et al. |
| 8,541,562 B2 | 9/2013 | Obika et al. |
| 8,546,556 B2 | 10/2013 | Seth et al. |
| 8,592,156 B2 | 11/2013 | Liu et al. |
| 8,637,478 B2 | 1/2014 | Bennett |
| RE44,779 E | 2/2014 | Imanishi et al. |
| 8,653,252 B2 | 2/2014 | Elmen et al. |
| 8,673,560 B2 | 3/2014 | Leamon et al. |
| 8,680,254 B2 | 3/2014 | Lutz et al. |
| 8,691,783 B2 | 4/2014 | Thum et al. |
| 8,703,728 B2 | 4/2014 | Swayze et al. |
| 8,710,021 B2 | 4/2014 | Anro et al. |
| 8,735,366 B2 | 5/2014 | Bauer et al. |
| 8,748,089 B2 | 6/2014 | Kariko et al. |
| 8,779,118 B2 | 7/2014 | Allerson et al. |
| 8,796,437 B2 | 8/2014 | Swayze et al. |
| 8,809,516 B2 | 8/2014 | Manoharan et al. |
| 8,846,386 B2 | 9/2014 | Ambati et al. |
| 8,846,637 B2 | 9/2014 | Seth et al. |
| 8,846,639 B2 | 9/2014 | Swayze et al. |
| 8,846,885 B2 | 9/2014 | Hirai et al. |
| 8,895,722 B2 | 11/2014 | Iversen et al. |
| 8,957,040 B2 | 2/2015 | Bennett et al. |
| 8,957,200 B2 | 2/2015 | Seth et al. |
| 8,957,201 B2 | 2/2015 | Kaneko et al. |
| 9,005,906 B2 | 4/2015 | Swayze et al. |
| 9,006,194 B2 | 4/2015 | Katsikis et al. |
| 9,006,415 B2 | 4/2015 | Ren et al. |
| 9,012,139 B2 | 4/2015 | Collard et al. |
| 9,029,335 B2 | 5/2015 | Prakash et al. |
| 9,045,518 B2 | 6/2015 | Christensen et al. |
| 9,045,754 B2 | 6/2015 | Bhanot et al. |
| 9,057,066 B2 | 6/2015 | Hung et al. |
| 9,109,001 B2 | 8/2015 | Parsy et al. |
| 9,127,272 B2 | 9/2015 | Esau et al. |
| 9,127,276 B2 | 9/2015 | Prakash et al. |
| 9,156,873 B2 | 10/2015 | Prakash et al. |
| 9,157,081 B2 | 10/2015 | Bennett et al. |
| 9,181,549 B2 | 11/2015 | Prakash et al. |
| 9,187,515 B2 | 11/2015 | Mayes et al. |
| 9,192,621 B2 | 11/2015 | Mayes et al. |
| 9,193,752 B2 | 11/2015 | Migawa et al. |
| 9,193,969 B2 | 11/2015 | Montefeltro et al. |
| 9,211,300 B2 | 12/2015 | Mayes et al. |
| 9,217,147 B2 | 12/2015 | Singh et al. |
| 9,221,864 B2 | 12/2015 | Seth et al. |
| 9,243,245 B2 | 1/2016 | De Kimpe et al. |
| 9,290,534 B2 | 3/2016 | Seth et al. |
| 9,296,778 B2 | 3/2016 | Parsy et al. |
| 9,309,275 B2 | 4/2016 | Stewart et al. |
| 9,315,535 B2 | 4/2016 | Mitsuoka et al. |
| 9,334,495 B2 | 5/2016 | Khvorova et al. |
| 9,339,541 B2 | 5/2016 | Dousson et al. |
| 9,347,068 B2 | 5/2016 | Dhugga et al. |
| 9,359,445 B2 | 6/2016 | Finkbeiner et al. |
| 9,359,603 B2 | 6/2016 | Lutz et al. |
| 9,410,155 B2 | 8/2016 | Collard et al. |
| 9,428,534 B2 | 8/2016 | Christensen et al. |
| 9,447,166 B2 | 9/2016 | Ambati et al. |
| 9,453,261 B2 | 9/2016 | Lee et al. |
| 9,464,292 B2 | 10/2016 | Okumura et al. |
| 9,499,818 B2 | 11/2016 | Van Deutekom |
| 9,518,259 B2 | 12/2016 | Rigo et al. |
| 9,534,222 B2 | 1/2017 | Ambati et al. |
| 9,550,988 B2 | 1/2017 | Swayze |
| 9,714,422 B2 | 7/2017 | Vorechovsky et al. |
| 9,745,577 B2 | 8/2017 | Vorechovsky et al. |
| 9,771,579 B2 | 9/2017 | Collard et al. |
| 9,976,143 B2 | 5/2018 | Krainer et al. |
| 10,196,639 B2 | 2/2019 | Vorechovsky et al. |
| 2003/0148974 A1 | 8/2003 | Monia et al. |
| 2004/0063129 A1 | 4/2004 | Gaarde et al. |
| 2004/0219515 A1 | 11/2004 | Bentwich |
| 2005/0221354 A1 | 10/2005 | Mounts |
| 2005/0233327 A1 | 10/2005 | Welch et al. |
| 2006/0062790 A1 | 3/2006 | Reinhard et al. |
| 2006/0134670 A1 | 6/2006 | Piu |
| 2006/0166922 A1 | 7/2006 | Eichler et al. |
| 2007/0009899 A1 | 1/2007 | Mounts |
| 2007/0087376 A1 | 4/2007 | Potashkin |
| 2007/0249538 A1 | 10/2007 | Sazani et al. |
| 2008/0269123 A1 | 10/2008 | Li et al. |
| 2009/0186846 A1 | 7/2009 | Chabot et al. |
| 2009/0186946 A1 | 7/2009 | Taketomi et al. |
| 2009/0264353 A1 | 10/2009 | Orum et al. |
| 2009/0270332 A1 | 10/2009 | Bare et al. |
| 2010/0150839 A1 | 6/2010 | Kelleher |
| 2010/0166784 A1 | 7/2010 | Murphy et al. |
| 2011/0124591 A1 | 5/2011 | Bennett |
| 2011/0229891 A1 | 9/2011 | Michaud et al. |
| 2012/0190728 A1 | 7/2012 | Bennett et al. |
| 2012/0252877 A1 | 10/2012 | Lo |
| 2013/0072671 A1 | 3/2013 | Van Deutekom |
| 2013/0096183 A1 | 4/2013 | Collard et al. |
| 2013/0109850 A1 | 5/2013 | Prakash et al. |
| 2013/0136732 A1 | 5/2013 | Wagner et al. |
| 2013/0184223 A1 | 7/2013 | Land et al. |
| 2013/0253036 A1 | 9/2013 | Collard et al. |
| 2013/0266560 A1 | 10/2013 | Demopulos et al. |
| 2013/0289092 A1 | 10/2013 | Rigo et al. |
| 2014/0011761 A1 | 1/2014 | Hotamisligil et al. |

(56) References Cited

U.S. PATENT DOCUMENTS

| | | | |
|---|---|---|---|
| 2014/0128449 A1 | 5/2014 | Liu et al. |
| 2014/0186839 A1 | 7/2014 | Margulies et al. |
| 2014/0194610 A1 | 7/2014 | Verdine et al. |
| 2014/0235605 A1 | 8/2014 | Shiffman et al. |
| 2014/0309181 A1 | 10/2014 | Collard et al. |
| 2014/0343127 A1 | 11/2014 | Kammler |
| 2014/0349290 A1 | 11/2014 | Watnick et al. |
| 2014/0378526 A1 | 12/2014 | Rossi et al. |
| 2014/0378527 A1 | 12/2014 | Van Deutekom |
| 2014/0378533 A1 | 12/2014 | Freier |
| 2015/0004217 A1 | 1/2015 | Guild et al. |
| 2015/0018540 A1 | 1/2015 | Prakash et al. |
| 2015/0184153 A1 | 7/2015 | Freier et al. |
| 2015/0211006 A1 | 7/2015 | Butler et al. |
| 2015/0211010 A1 | 7/2015 | Kerem et al. |
| 2015/0232845 A1 | 8/2015 | Ozsolak |
| 2015/0232858 A1 | 8/2015 | Ozsolak |
| 2015/0238516 A1 | 8/2015 | Dowdy et al. |
| 2015/0267192 A1 | 9/2015 | Heartlein et al. |
| 2015/0291957 A1 | 10/2015 | Smith |
| 2015/0329918 A1 | 11/2015 | Kang et al. |
| 2015/0337310 A1 | 11/2015 | Walker et al. |
| 2015/0361497 A1 | 12/2015 | Rose |
| 2016/0017322 A1 | 1/2016 | Vorechovsky et al. |
| 2016/0024500 A1 | 1/2016 | Popplewell et al. |
| 2016/0046935 A1 | 2/2016 | Bentwich et al. |
| 2016/0122767 A1 | 5/2016 | Gouya et al. |
| 2016/0201063 A1 | 7/2016 | Ozsolak |
| 2016/0201064 A1 | 7/2016 | Ozsolak |
| 2016/0208264 A1 | 7/2016 | Wilton et al. |
| 2016/0215291 A1 | 7/2016 | Garcia et al. |
| 2016/0244762 A1 | 8/2016 | Vorechovsky et al. |
| 2016/0244767 A1 | 8/2016 | Hastings |
| 2016/0298121 A1 | 10/2016 | Krainer et al. |
| 2017/0044540 A1 | 2/2017 | Sætrom et al. |
| 2017/0159049 A9 | 6/2017 | Krainer et al. |
| 2017/0240904 A1 | 8/2017 | Tallent et al. |
| 2018/0002694 A1 | 1/2018 | Vorechovsky et al. |
| 2018/0362987 A1 | 12/2018 | Krainer et al. |
| 2018/0369275 A1 | 12/2018 | Arnarez et al. |
| 2019/0024118 A1 | 1/2019 | Tagliatela et al. |
| 2019/0024119 A1 | 1/2019 | Tagliatela et al. |
| 2019/0024120 A1 | 1/2019 | Tagliatela et al. |
| 2019/0024121 A1 | 1/2019 | Tagliatela et al. |
| 2019/0070213 A1 | 3/2019 | Aznarez et al. |

FOREIGN PATENT DOCUMENTS

| | | | |
|---|---|---|---|
| EP | 1161439 B1 | 4/2010 | |
| EP | 1984381 B1 | 9/2010 | |
| EP | 1013661 B1 | 1/2012 | |
| EP | 2092065 B1 | 1/2012 | |
| EP | 2099461 B1 | 3/2012 | |
| EP | 2170917 B1 | 6/2012 | |
| EP | 2066684 B1 | 7/2012 | |
| EP | 2284269 A3 | 8/2012 | |
| EP | 2356129 B1 | 4/2013 | |
| EP | 2376516 B1 | 4/2013 | |
| EP | 2114981 B1 | 5/2013 | |
| EP | 2149605 B1 | 7/2013 | |
| EP | 2285819 B1 | 10/2013 | |
| EP | 2161038 B1 | 12/2013 | |
| EP | 1562971 B1 | 2/2014 | |
| EP | 2295441 B1 | 5/2014 | |
| EP | 2314594 B1 | 7/2014 | |
| EP | 2410053 B1 | 10/2014 | |
| EP | 2176280 B2 | 6/2015 | |
| EP | 2361921 B1 | 6/2015 | |
| EP | 2462153 B1 | 7/2015 | |
| EP | 1015469 B2 | 11/2015 | |
| EP | 2173760 B2 | 11/2015 | |
| EP | 1937312 B1 | 6/2016 | |
| EP | 2141233 B1 | 10/2016 | |
| EP | 2410054 B1 | 1/2017 | |
| GB | 2546719 A | 8/2017 | |
| WO | WO-9402501 A1 | 2/1994 | |
| WO | WO-9426887 A1 | 11/1994 | |
| WO | WO-2005049651 A2 | 6/2005 | |
| WO | WO-2006107846 A2 | 10/2006 | |
| WO | WO-2007002390 A2 | 1/2007 | |
| WO | WO-2007048628 A2 | 5/2007 | |
| WO | WO-2007048629 A2 | 5/2007 | |
| WO | WO-2007056113 A2 * | 5/2007 | ........... C12Q 1/6876 |
| WO | WO-2007002390 A3 | 11/2007 | |
| WO | WO-2009084472 A1 | 7/2009 | |
| WO | WO-2010148249 A1 | 12/2010 | |
| WO | WO-2011057350 A1 | 5/2011 | |
| WO | WO-2012178146 A1 | 12/2012 | |
| WO | WO-2013081755 A1 | 6/2013 | |
| WO | WO-2013106770 A1 | 7/2013 | |
| WO | WO-2013119916 A2 | 8/2013 | |
| WO | WO-2013119916 A3 | 10/2013 | |
| WO | WO-2014012081 A2 | 1/2014 | |
| WO | WO-201428459 A1 | 2/2014 | |
| WO | WO-2014028459 A1 | 2/2014 | |
| WO | WO-2014031575 A1 | 2/2014 | |
| WO | WO-2014049536 A2 | 4/2014 | |
| WO | WO-2014121287 A2 | 8/2014 | |
| WO | WO-2014172698 A1 | 10/2014 | |
| WO | WO-2014201413 A1 | 12/2014 | |
| WO | WO-2014209841 A2 | 12/2014 | |
| WO | WO-2015024876 A2 | 2/2015 | |
| WO | WO-2015035091 A1 | 3/2015 | |
| WO | WO-2015024876 A3 | 7/2015 | |
| WO | WO-2014209841 A3 | 10/2015 | |
| WO | WO-2015190922 A1 | 12/2015 | |
| WO | WO-2015193651 A1 | 12/2015 | |
| WO | WO-2015198054 A1 | 12/2015 | |
| WO | WO-2016027168 A2 | 2/2016 | |
| WO | WO-2015193651 A4 | 3/2016 | |
| WO | WO-2016027168 A3 | 4/2016 | |
| WO | WO-2016054615 A2 | 4/2016 | |
| WO | WO-2016061509 A1 | 4/2016 | |
| WO | WO-2016054615 A3 | 5/2016 | |
| WO | WO-2016077837 A1 | 5/2016 | |
| WO | WO-2016087842 A1 | 6/2016 | |
| WO | WO-2016118697 A1 | 7/2016 | |
| WO | WO-2016128343 A1 | 8/2016 | |
| WO | WO-2016138534 A2 | 9/2016 | |
| WO | WO-2016161429 A1 | 10/2016 | |
| WO | WO-2016196386 A1 | 12/2016 | |
| WO | WO-2017053982 A1 | 3/2017 | |
| WO | WO-2017060731 A1 | 4/2017 | |
| WO | WO-2017106210 A1 | 6/2017 | |
| WO | WO-2017106211 A1 | 6/2017 | |
| WO | WO-2017106283 A1 | 6/2017 | |
| WO | WO-2017106292 A1 | 6/2017 | |
| WO | WO-2017106364 | 6/2017 | |
| WO | WO-2017106364 A2 | 6/2017 | |
| WO | WO-2017106370 A1 | 6/2017 | |
| WO | WO-2017106375 A1 | 6/2017 | |
| WO | WO-2017106377 A1 | 6/2017 | |
| WO | WO-2017106382 A1 | 6/2017 | |
| WO | WO-2017106364 A3 | 7/2017 | |
| WO | WO-2018007980 A1 | 1/2018 | |
| WO | WO-2018187363 A1 | 10/2018 | |
| WO | WO-2019040923 A1 | 2/2019 | |
| WO | WO-2019084050 A1 | 5/2019 | |

OTHER PUBLICATIONS

Aizer AA, et al. Lack of reduction in racial disparities in cancer-specific mortality over a 20-year period. Cancer. 2014;120:1532-9.
Altschul SF et al.Basic local alignment search tool. J. Mol. Biol., vol. 215, No. 3, pp. 403-410, (Oct. 5, 1990).
Aly, et al. Extreme genetic risk for type 1A diabetes. Proc Natl Acad Sci U S A. Sep. 19, 2006;103(38):14074-9. Epub Sep. 11, 2006.
Amarnath, S. et al. The PDL1-PD1 Axis Converts Human TH1 Cells into Regulatory T Cells. Science Translational Medicine, vol. 3, No. 111, pp. 1-13. (Nov. 30, 2011).
Anders S. et al. Detecting differential usage of exons from RNA-seq data. Genome Res. 2012;22(10):2008-17. Epub Jun. 23, 2012.doi: gr.133744.111 [pii] 10.1101/gr.133744.111. PubMed PMID: 22722343.

(56) References Cited

OTHER PUBLICATIONS

Au, K.S. et al. Molecular Genetic Basis of Tuberous Sclerosis Complex: From Bench to Bedside.Journal of Child Neurology. vol. 19, No. 9 (Sep. 2004).
Audentes Therapeutics Announces Expansion of AAV Technology Platform and Pipeline with New Development Programs for Duchenne Muscular Dystrophy and Myotonic Dystrophy. PRNewswire Apr. 8, 2019 (7 pgs).
Aznarez, et al. Tango-Targeted augmentation of nuclear gene output— for the treatment of genetic diseases [abstract]. In: 2018 Annual Meeting Abstract of the American Society of Gene and Cell Therapy; May 16-19, 2018; Chicago, IL; 2018. Abstract No. 304.
Bakkenist CJ, Kastan MB. DNA damage activates ATM through intermolecular autophosphorylation and dimer dissociation. Nature. 2003;421(6922):499-506. doi: 10.1038/nature01368. PubMed PMID: 12556884.
Balagurumoorthy, et al. Hairpin and parallel quartet structures for telomeric sequences. Nucleic Acids Res. Aug. 11, 1992;20(15):4061-7.
Balkwill, et al. Repression of translation of human estrogen receptor alpha by G-quadruplex formation. Biochemistry. Dec. 8, 2009;48(48):11487-95. doi: 10.1021/bi901420k.
Barratt, et al. Remapping the insulin gene/IDDM2 locus in type 1 diabetes. Diabetes. Jul. 2004;53(7):1884-9.
Bassi et al. A novel mutation in the ATP1A2 gene causes alternating hemiplegia of childhood. J. Med. Genet. 41:621-628 (2004).
Battistini et al. A new CACNA1A gene mutation in acetazolamide-responsive familial hemiplegic migraine and ataxia.Neurology, vol. 53, No. 1, pp. 38-43 (Jul. 13, 1999).
Baughan, et al. Delivery of bifunctional RNAs that target an intronic repressor and increase SMN levels in an animal model of spinal muscular atrophy. Hum Mol Genet. May 1, 2009;18(9):1600-11. doi: 10.1093/hmg/ddp076. Epub Feb. 19, 2009.
Bauman et al. Therapeutic potential of splice-switching oligonucleotides. Oligonucleotides 19.1 (2009): 1-13.
Beaudoin, et al. 5'-UTR G-quadruplex structures acting as translational repressors. Nucleic Acids Res. Nov. 2010;38(20):7022-36. doi: 10.1093/nar/gkq557. Epub Jun. 22, 2010.
Belt P, et al., Proteomic investigations reveal a role for RNA processing factor THRAP3 in the DNA damage response. Mol Cell. 2012;46(2):212-25. doi: 10.1016/j.molcel.2012.01.026. PubMed PMID: 22424773; PubMed Central PMCID: PMC3565437.
Berge, SM et al. Pharmaceutical Salts Journal of Pharmaceutical Sciences, vol. 66, No. 1, pp. 1-19 (1977).
Berger, W. et al. The molecular basis of human retinal and vitreoretinal diseases. Progress in Retinal and Eye Research . vol. 29, pp. 335-375 (2010).
Bethke L, et al. Comprehensive analysis of the role of DNA repair gene polymorphisms on risk of glioma. Hum Mol Genet. 2008;17(6):800-5. Epub Dec. 1, 2007.doi: ddm351 [pii] 10.1093/hmg/ddm351. PubMed PMID: 18048407.
Bicknell, et al. Introns in UTRs: why we should stop ignoring them. Bioessays. Dec. 2012;34(12):1025-34. doi: 10.1002/bies.201200073. Epub Oct. 26, 2012.
Blencowe BJ. Splicing regulation: the cell cycle connection. Curr Biol. 2003;13(4):R149-51. PubMed PMID: 12593819.
Blencowe, Benjamin. Reflections for the 20th anniversary issue of RNA journal.RNA Journal, vol. 21, No. 4, pp. 573-575 (2015).
Blencowe, Intron Retention, Supplemental Figure Legends.
Bonnen, P.E., et al. Haplotypes at ATM identify coding-sequence variation and indicate a region of extensive linkage disequilibrium. Am J Hum Genet. 2000;67(6):1437-51. Epub Nov. 15, 2000.doi: S0002-9297(07)63213-3 [pii] 10.1086/316908. PubMed PMID: 11078475.
Boothby, T. et al. Removal of Retained Introns Regulates Translation in the Rapidly Developing Gametophyte of Marsilea vestita. Developmental Cell vol. 24, pp. 517-529, (Mar. 11, 2013).
Booy, et al. The RNA helicase RHAU (DHX36) unwinds a G4-quadruplex in human telomerase RNA and promotes the formation of the P1 helix template boundary. Nucleic Acids Res. May 2012;40(9):4110-24. doi: 10.1093/nar/gkr1306. Epub Jan. 11, 2012.
Boutz, et al. Detained introns are a novel, widespread class of post-transcriptionally spliced introns. Genes Dev. Jan. 1, 2015;29(1):63-80. doi: 10.1101/gad.247361.114.
Braunschweig et al., "Widespread intron retention in mammal functionally tunes transcriptomes", Chold Spring Harbor Laboratory Press, 2014 p. 1-14.
Braunschweig, et al. Widespread intron retention in mammals functionally tunes transcriptomes. Widespread intron retention in mammals functionally tunes transcriptomes. Genome Res. Nov. 2014;24(11):1774-86. doi: 10.1101/gr.177790.114. Epub Sep. 25, 2014.
Bravo-Gil, et al., Improving the management of Inherited Retinal Dystrophies by targeted sequencing of a population-specific gene panel, Scientific Reports, 6:23910, 10 pages.
Brooks, A.N., et al. A pan-cancer analysis of transcriptome changes associated with somatic mutations in U2AF1 reveals commonly altered splicing events. PLoS One. 2014; 9(1):e87361. Epub Feb. 6, 2014.doi: 10.1371/journal.pone.0087361 PONE-D-13-26905 [pii]. PubMed PMID: 24498085.
Buchman, et al. Comparison of intron-dependent and intron-independent gene expression. Mol Cell Biol. Oct. 1988;8(10):4395-405.
Buckley, P.T. et al. Cytoplasmic intron retention, function, splicing, and the sentinel RNA hypothesis.WIREs RNA, vol. 5, pp. 223-2330 (Mar./Apr. 2014).
Bugaut, et al. 5'-UTR RNA G-quadruplexes: translation regulation and targeting. Nucleic Acids Res. Jun. 2012;40(11):4727-41. doi: 10.1093/nar/gks068. Epub Feb. 20, 2012.
Bugaut, et al. An RNA hairpin to G-quadruplex conformational transition. J Am Chem Soc. Dec. 12, 2012;134(49):19953-6. doi: 10.1021/ja308665g. Epub Nov. 29, 2012.
Buratti, et al. DBASS3 and DBASS5: databases of aberrant 3'- and 5'-splice sites. Nucleic Acids Res. Jan. 2011;39(Database issue):D86-91. doi: 10.1093/nar/gkq887. Epub Oct. 6, 2010.
Buratti, et al. RNA folding affects the recruitment of SR proteins by mouse and human polypurinic enhancer elements in the fibronectin EDA exon. Mol Cell Biol. Feb. 2004;24(3):1387-400.
Burnette et al. Subdivision of large introns in *Drosophila* by recursive splicing at non-exonic elements. Genetics (2005).
Burns, CG, et al. Connections between pre-mRNA processing and regulation of the eukaryotic cell cycle. Front Horm Res. 1999; 25:59-82.
Buschmann et al. Chitosans for delivery of nucleic acids. Advanced drug delivery reviews 65.9 (2013): 1234-1270.
Busslinger, et al. β+ Thalassemia: Aberrant splicing results from a single point mutation in an intron. Cell 27.2 (1981): 289-298.
Callis, et al. Introns increase gene expression in cultured maize cells. Genes Dev. Dec. 1987;1(10):1183-200.
Catterall, et al. Nav1.1 channels and epilepsy. J Physiol. Jun. 1, 2010;588(Pt 11):1849-59.
Cavaloc, et al. The splicing factors 9G8 and SRp20 transactivate splicing through different and specific enhancers. RNA. Mar. 1999;5(3):468-83.
Cazzola, et al. Translational pathophysiology: a novel molecular mechanism of human disease. Blood. Jun. 1, 2000;95(11):3280-8.
Chambers, A.L., et al. The INO80 chromatin remodeling complex prevents polyploidy and maintains normal chromatin structure at centromeres. Genes Dev. 2012; 26(23):2590-603. Epub Dec. 5, 2012.doi: 26/23/2590 [pii] 10.1101/gad.199976.112. PubMed PMID: 23207916.
Chen, M.S., et al. Chk1 kinase negatively regulates mitotic function of Cdc25A phosphatase through 14-3-3 binding. Mol Cell Biol. 2003; 23(21):7488-97. PubMed PMID: 14559997; PubMed Central PMCID: PMC207598.
Chen, T., et al. A functional single nucleotide polymorphism in promoter of ATM is associated with longevity. Mech Ageing Dev. 2010; 131:636-40.
Choi, HH, et al. CHK2 kinase promotes pre-mRNA splicing via phosphorylating CDK11p110. Oncogene. 2014; 33:108-15.

(56) References Cited

OTHER PUBLICATIONS

Colla, S., et al. Telomere dysfunction drives aberrant hematopoietic differentiation and myelodysplastic syndrome. Cancer Cell. 2015; 27(5):644-57. doi: 10.1016/j.ccell.2015.04.007. PubMed PMID: 25965571.
Collie, et al. The application of DNA and RNA G-quadruplexes to therapeutic medicines. Chem Soc Rev. Dec. 2011;40(12):5867-92. doi: 10.1039/c1cs15067g. Epub Jul. 25, 2011.
Consortium. TGP. An integrated map of genetic variation from 1,092 human genomes. Nature (London). 2012; 491:56-65.
Co-pending U.S. Appl. No. 15/619,984, filed Jun. 12, 2016.
Corallini et al. Transcriptional and Posttranscriptional Regulation of the CTNS Gene. Pediatric Research 70(2):130-135 (Aug. 2011).
Corey, S.J., et al. A non-classical translocation involving 17q12 (retinoic acid receptor alpha) in acute promyelocytic leukemia (APML) with atypical features. Leukemia. 1994; 8(8):1350-3. PubMed PMID: 8057672.
Corvelo, A., et al. Genome-wide association between branch point properties and alternative splicing. PLoS Comput Biol. 2010; 6(11):e1001016. Epub Dec. 3, 2010.doi: 10.1371/journal.pcbi. 1001016. PubMed PMID: 21124863.
Coulombe-Huntington J., et al. Fine-Scale Variation and Genetic Determinants of Alternative Splicing across Individuals. PLoS Genet. 2009; 5(12):e1000766. Epub Dec. 17, 2009.doi: 10.1371/journal.pgen.1000766. PubMed PMID: 20011102.
Coutinho, G., et al. Functional significance of a deep intronic mutation in the ATM gene and evidence for an alternative exon 28a. Hum Mutat. 2005; 25(2):118-24. Epub Jan. 12, 2005.doi: 10.1002/humu.20170. PubMed PMID: 15643608.
Creacy, et al. G4 resolvase 1 binds both DNA and RNA tetramolecular quadruplex with high affinity and is the major source of tetramolecular quadruplex G4-DNA and G4-RNA resolving activity in HeLa cell lysates. J Biol Chem. Dec. 12, 2008;283(50):34626-34. doi: 10.1074/jbc.M806277200. Epub Oct. 7, 2008.
Culler, et al. Functional selection and systematic analysis of intronic splicing elements identify active sequence motifs and associated splicing factors. Nucleic Acids Res. Aug. 2010;38(15):5152-65. doi: 10.1093/nar/gkq248. Epub Apr. 12, 2010.
Database Geneseq [Online],Nov. 13, 2008 (Nov. 13, 2008), Dual label detection probe, QF probe 1, 5. 3.11, XP055572852, retrieved from EBI Accession No. GSN:ARK21623.
Davies, et al. A genome-wide search for human type 1 diabetes susceptibility genes. Nature. Sep. 8, 1994;371(6493):130-6.
Decorsiere, et al. Essential role for the interaction between hnRNP H/F and a G quadruplex in maintaining p53 pre-mRNA 3'-end processing and function during DNA damage. Genes Dev. Feb. 1, 2011;25(3):220-5. doi: 10.1101/gad.607011.
Dedic, T. et al. Alagille Syndrome Mimicking Biliary Atresia in Early Infancy, PLOS OONE, 10(11):e0143939: pp. 1-7 (Nov. 20, 2015).
Deere, J. et al. AntisensePhosphorodiamidate Morpholino OligomerLengthand TargetPositionEffects on Gene-SpecificInhibitionin *Escherichia coli*. Antimicrobial Agents Andchemotherapy, vol. 49, No. 1, p. 249-255(Jan. 2005).
Derecka, et al. Occurrence of a quadruplex motif in a unique insert within exon C of the bovine estrogen receptor alpha gene (ESR1). Biochemistry. Sep. 7, 2010;49(35):7625-33. doi: 10.1021/bi100804f.
Dias, N. et al. Antisense oligonucleotides: basic concepts and mechanisms Mol. Cancer Ther. vol. 1, pp. 347-355, (Mar. 2002).
Didiot, et al. The G-quartet containing FMRP binding site in FMR1 mRNA is a potent exonic splicing enhancer. Nucleic Acids Res. Sep. 2008;36(15):4902-12. doi: 10.1093/nar/gkn472. Epub Jul. 24, 2008.
Ding, H. et al. DeliveringPD-1 inhibitory signal concomitant with blocking ICOS co-stimulation suppresses lupus-like syndrome in autoimmune BXSB mice.Clinical Immunology, vol. 118, pp. 258-267, (2006).
Divina, P. et al. Ab initio prediction of cryptic splice-site activation and exon skipping. Eur J Hum Genet. 2009; 17:759-65.

Dominski, et al. Restoration of correct splicing in thalassemic pre-mRNA by antisense oligonucleotides. Proc Natl Acad Sci U S A. Sep. 15, 1993;90(18):8673-7.
Dredge, et al. NeuN/Rbfox3 Nuclear and Cytoplasmic Isoforms Differentially Regulate Alternative Splicing and Nonsense-Mediated Decay of Rbfox2. PLoS One. 2011; 6(6): e21585.
Du, et al. Correction of prototypic ATM splicing mutations and aberrant ATM function with antisense morpholino oligonucleotides. Proc Natl Acad Sci U S A. Apr. 3, 2007;104(14):6007-12. Epub Mar. 26, 2007.
Du, et al., "Downregulation of neuronal sodium channel subunits Nav.1. and Nav1.6 in the sinoatrial node from volume-overloaded heart failure rat", Pflugers Arch—Eur J Physiol (2007) 454:451-459.
Ducros et al.Recurrence of the T666M calcium channel CACNA1A gene mutation in familial hemiplegic migraine with progressive cerebellar ataxia.Am J Hum Genet. vol. 64, No. 1, pp. 89-98 (Jan. 1999).
Duryagina R, et al. Overexpression of Jagged-1 and its intracellular domain in human mesenchymal stromal cells differentially affect the interaction with hematopoietic stem and progenitor cells.Stem Cells Dev. vol. 22, No. 20, pp. 2736-2750 (2013).
Dutertre, M., et al. et al. DNA damage: RNA-binding proteins protect from near and far. Trends Biochem Sci. 2014; 39(3):141-9. Epub Feb. 19, 2014.doi: S0968-0004(14)00015-2 [pii] 10.1016/j.tibs.2014.01.003. PubMed PMID: 24534650.
Eddy, et al. G4 motifs correlate with promoter-proximal transcriptional pausing in human genes. Nucleic Acids Res. Jul. 2011;39(12):4975-83. doi: 10.1093/nar/gkr079. Epub Mar. 3, 2011.
El Bougrini, J., et al. PML positively regulates interferon gamma signaling. Biochimie. 2011; 93(3):389-98. doi: 10.1016/j.biochi. 2010.11.005. PubMed PMID: 21115099.
Emerick, et al. Multivariate analysis and visualization of splicing correlations in single-gene transcriptomes. BMC Bioinformatics. Jan. 18, 2007;8:16.
EP 15846242.4 Partial Supplementary Search Report and Search Opinion dated May 2, 2018.
EP 16876621.0 Extended European Search Report and Search Opinion dated Mar. 7, 2019.
EP15729929.8 Office Action dated Dec. 22, 2017.
EP15729929.8 Office Action dated Oct. 30, 2018.
EP15846242.4 Extended European Search Report dated Aug. 21, 2018.
EP16781187.6 Office Action dated May 20, 2019.
EP16876499.1 Extended Search Report dated Jun. 14, 2019.
EP168766061.1 Extended Search Report dated May 24, 2019.
Fairbrother, W.G., et al. Predictive identification of exonic splicing enhancers in human genes. Science. 2002; 297(5583):1007-13. PubMed PMID: 12114529.
Fededa, et al. A polar mechanism coordinates different regions of alternative splicing within a single gene. Mol Cell. Aug. 5, 2005;19(3):393-404.
Ferreira, P.G., et al. Transcriptome characterization by RNA sequencing identifies a major molecular and clinical subdivision in chronic lymphocytic leukemia. Genome Res. 2014; 24:212-26.
Fletcher, Sue et al. Antisense suppression of donor splice site mutations in the dystrophin gene transcript.Molecular Genetics & Genomic Medicine, vol. 1, No. 3, pp. 162-173, Jun. 13, 2013.
Fred, et al. The human insulin mRNA is partly translated via a cap- and eIF4A-independent mechanism. Biochem Biophys Res Commun. Sep. 9, 2011;412(4):693-8. doi: 10.1016/j.bbrc.2011.08.030. Epub Aug. 16, 2011.
Friedman, KJ et al. Correction of aberrant splicing of the cystic fibrosis transmembrane conductance regulator (CFTR) gene by antisense oligonucleotides. J Biol Chem. Dec. 17, 1999;274(51):36193-36199.
Friend, KL et al. Detection of a novel missense mutation and second recurrent mutation in the CACNA1A gene in individuals with EA-2 and FHM. Hum Genet. vol. 105(3):261-5 (Sep. 1999).
Furukawa & Kish 2008, GeneReviews Pagon Ra et al. eds. Univ. of WA Seattle, NCBI Bookshelf ID NBK1437.
Galante, et al. Detection and evaluation of intron retention events in the human transcriptome. RNA. May 2004;10(5):757-65.

(56) References Cited

OTHER PUBLICATIONS

Garner, et al. Selectivity of small molecule ligands for parallel and anti-parallel DNA G-quadruplex structures. Org Biomol Chem. Oct. 21, 2009;7(20):4194-200. doi: 10.1039/b910505k. Epub Aug. 14, 2009.

Geary et al. Absolute Bioavailability of 29-O-(2-Methoxyethyl)-Modified Antisense Oligonucleotides following Intraduodenal Instillation in Rats. J Pharmacal Exp Ther. vol. 296, No. 3, pp. 898-904 (Mar. 2001).

Geary, RS, et al., Pharmacokinetic properties of 2'-O-(2-methoxyethyp-modified oligonucleotide analogs in ratsJ Pharmacal Exp Ther. vol. 296, No. 3, pp. 890-897 (Mar. 2001).

Gianchecchi et al. Recent insights into the role of the PD-1/PD-L1 pathway in immunological tolerance and autoimmunity. Autoimmunity Reviews 12:1091-1100 (2013).

Gibson, G. Hints of hidden heritability in GWAS. Nat Genet. 2010; 42(7):558-60. Epub Jun. 29, 2010.doi: ng0710-558 [pii] 10.1038/ng0710-558. PubMed PMID: 20581876.

Gohring, J. et al. Imaging of Endogenous MessengerRNA Splice Variants in Living Cells Reveals Nuclear Retention of Transcripts Inaccessible to Nonsense-Mediated Decay in *Arabidopsis*.The Plant Cell.vol. 26, pp. 754-764.(Feb. 2014).

Gomes et al. Translating chitosan to clinical delivery of nucleic acid-based drugs. MRS bulletin 39.1 (2014): 60-70.

Gomez, et al. Telomerase downregulation induced by the G-quadruplex ligand 12459 in A549 cells is mediated by hTERT RNA alternative splicing. Nucleic Acids Res. Jan. 16, 2004;32(1):371-9. Print 2004.

Goncharova et al. Tuberin regulates p70 S6 kinase activation and ribosomal protein S6 phosphorylation. A role for the TSC2 tumor suppressor gene in pulmonary lymphangioleiomyomatosis (LAM). J. Biol. Chem. (Aug. 23, 2002) 277(34);30958-67. EPub Jun. 3, 2002.

Gonzalez-Santos, et al., Mutation in the splicing factor Hprp3p linked to retinitis pigmentosa impairs interactions within the U4/U6 snRNP pigmentosa impairs interactions within the U4/U6 snRNP complex, PubMed Central Canada , Author Manuscript, 29 pages.

Goyenvalie, et al. Therapeutic approaches to muscular dystrophy. Hum Mol Genet. Apr. 15, 2011;20(R1):R69-78. doi: 10.1093/hmg/ddr105. Epub Mar. 24, 2011.

Gozani, O., et al. A potential role for U2AF-SAP 155 interactions in recruiting U2 snRNP to the branch site. Mol Cell Biol. 1998; 18(8):4752-60. PubMed PMID: 9671485.

Graveley, B.R. The haplo-spliceo-transcriptome: common variations in alternative splicing in the human population. Trends Genet. 2008; 24(1):5-7. Epub 2007/12/07.doi: S0168-9525(07)00349-6 [pii] 10.1016/j.tig.2007.10.004. PubMed PMID: 18054116.

Gutell, R.R., et al. A story: unpaired adenosine bases in ribosomal RNAs. J Mol Biol. 2000; 304(3):335-54. Epub Nov. 25, 2000.doi: 10.1006/jmbi.2000.4172 S0022-2836(00)94172-X [pii]. PubMed PMID: 11090278.

Guth, S., et al. Dual function for U2AF(35) in AG-dependent pre-mRNA splicing. Mol Cell Biol. 2001;21(22):7673-81. PubMed PMID: 11604503.

Guy et al. A mouse Mecp2-null mutation causes neurological symptoms that mimic Rett syndrome. Nat Genet 27:322-326 (2001).

Hai, et al. A G-tract element in apoptotic agents-induced alternative splicing. Nucleic Acids Res. Jun. 2008;36(10):3320-31. doi: 10.1093/nar/gkn207. Epub Apr. 24, 2008.

Hamdan, F. et al. Mutations in SYNGAP1 in Autosomal Nonsyndromic Mental Retardation.The New England Journal of Medicine.N.Engl. Med. vol. 360, No. 6, pp. 599, (Feb. 5, 2009).

Hamdan, F. F. et al. De Novo SYNGAP1 Mutations in Nonsyndromic Intellectual Disability and Autism, Biol. Psychiatry, 69:898-901 (2011).

Han, et al. TANGO-Targeted augmentation of nuclear gene output for the treatment of genetic diseases. Poster session presented at the American Society of Gene and Cell Therapy, Chicago, IL. (May 2018).

Han, et al., "TANGO—Targeted Augmentation of Nuclear Gene Output for the Treatment of Genetic Diseases" Poster.

Hargous, et al. Molecular basis of RNA recognition and TAP binding by the SR proteins SRp20 and 9G8. EMBO J. Nov, 1, 2006;25(21):5126-37. Epub Oct. 12, 2006.

Harkin, et al. The spectrum of SCN1A-related infantile epileptic encephalopathies. Brain. Mar. 2007;130(Pt 3):843-52.

Hastings, M.L., et al. Control of pre-mRNA splicing by the general splicing factors PUF60 and U2AF. PLoS ONE. 2007;2:e538. PubMed PMID: 17579712.

He, Y.H., et al. Association of the insulin-like growth factor binding protein 3 (IGFBP-3) polymorphism with longevity in Chinese nonagenarians and centenarians. Aging (Milano). 2014;6:944-56.

Hegele, et al. Dynamic protein-protein interaction wiring of the human spliceosome. Mol Cell. Feb. 24, 2012;45(4):567-80. doi: 10.1016/j.molcel.2011.12.034.

Hernan, I. et al. Cellular Expression and siRNA-Mediated Interference of Rhodopsin cis-Acting Splicing Mutants Associated with Autosomal Dominant Retinitis Pigmentosa, Invest Ophthalmol. Vis. Sci. (2011) 52:3723-3729.

Heyn, P. et al. Introns and gene expression: Cellular constraints, transcriptional regulation, and evolutionary consequences. Bioessays vol. 37, pp. 148-154 (2014).

Hiller et al. Pre-mRNA secondary structures influence exon recognition. PLoS genetics 3.11 (2007): e204.

Hirata et al.Prevention of Experimental Autoimmune Encephalomyelitis by Transfer of Embryonic Stem Cell-Derived Dendritic Cells Expressing Myelin Oligodendrocyte Glycoprotein Peptide along with TRAIL or Programmed Death-1 Ligand.J. Immunology vol. 174 pp. 1888-1897 (2005).

Hishida, A. et al. Polymorphisms in Ppar Genes (PPARD, PPARG, and PPARGC1A) and the Risk of Chronic Kidney Disease in Japanese: Cross-Sectional Data from the J-MICC Study. PPAR 2013; 980471 pp. 1-8.

Hishida, et al., Polymorphisms in PPAR Genes (PPARD, PPARG, and PPARGC1A) and the Risk of Chronic Kidney Disease in Japanese: Cross-Sectional Data from the J-MICC Study, PPAR Research, vol. 2013, Article ID 980471, 8 pages.

*Homo sapiens* pre-mRNA processing factor 3 (PRPF3), mRNA, NCBI Reference Sequence: NM_004698.2 Accessed Apr. 6, 2017.

Hua et al. Antisense masking of an hnRNP A1/A2 intronic splicing silencer corrects SMN2 splicing in transgenic mice. Am. J. Hum. Genet. 82:834-848 (Mar. 27, 2008).

Hua, et al. Antisense correction of SMN2 splicing in the CNS rescues necrosis in a type III SMA mouse model. Genes Dev. Aug. 1, 2010;24(15):1634-44. doi: 10.1101/gad.1941310. Epub Jul. 12, 2010.

Hua, Y., et al. Enhancement of SMN2 exon 7 inclusion by antisense oligonucleotides targeting the exon. PLoS Biol. 2007;5(4):e73. Epub Mar. 16, 2007.doi: 06-PLBI-RA-1492R3 [pii] 10.1371/journal.pbio.0050073. PubMed PMID: 17355180.

Hug, et al., "Mechanism an dregulation of the nonsense-mediated decay pathway", Nucleic Acids Research, 2016, vol. 44, No. 4 1483-1495.

Hunt, et al. Negligible impact of rare autoimmune-locus coding-region variants on missing heritability. Nature. Jun. 13, 2013;498(7453):232-5. doi: 10.1038/nature12170. Epub May 22, 2013.

Huynh, K.D., et al. BCoR, a novel corepressor involved in BCL-6 repression. Genes Dev. 2000;14(14):1810-23. PubMed PMID: 10898795; PubMed Central PMCID: PMC316791.

International Application No. PCT/GB2015/051756 International Preliminary Report on Patentability, dated Dec. 26, 2016.

International Application No. PCT/GB2015/051756 International Search Report and Written Opinion dated Nov. 30, 2015.

International Application No. PCT/GB2016/053136 International Search Report and Written Opinion dated Mar. 6, 2017.

International Application No. PCT/GB2016/053136 Partial International Search Report dated Jan. 19, 2017.

International Application No. PCT/US16/66576 International Search Report and Written Opinion dated May 4, 2017.

International Application No. PCT/US16/66691 International Search Report and Written Opinion dated May 10, 2017.

International Application No. PCT/US16/66708 International Search Report and Written Opinion dated May 8, 2017.

(56) References Cited

OTHER PUBLICATIONS

International Application No. PCT/US16/66721 International Search Report and Written Opinion dated May 1, 2017.
International Application No. PCT/US2015/053896 International Preliminary Report on Patentability dated Apr. 4, 2017.
International Application No. PCT/US2015/53896 International Search Report and Written Opinion dated Mar. 3, 2016.
International Application No. PCT/US2016/066414 International Search Report and Written Opinion dated Apr. 19, 2017.
International Application No. PCT/US2016/066417 International Search Report and Written Opinion dated Apr. 19, 2017.
International Application No. PCT/US2016/066564 International Search Report and Written Opinion dated May 4, 2017.
International Application No. PCT/US2016/066705 International Search Report and Written Opinion dated Apr. 24, 2017.
International Application No. PCT/US2018/048031 International Search Report and Written Opinion dated Jan. 22, 2019.
International search report and written opinion dated Jun. 5, 2017 for PCT Application No. PCT/US2016/066684.
International Search Report and Written Opinion dated Mar. 28, 2019 for PCT/US2018/057165.
International Search Report and Written Opinion for corresponding PCT application PCT/GB2016/053136 dated Jan. 19, 2017.
Itoh et al. Methyl CpG-binding Protein Isoform MeCP2_e2 Is Dispensable for Rett Syndrome Phenotypes but Essential for Embryo Viability and Placenta Development. J Biol Chem 287:13859-13867 (2012).
Iwamoto, et al. Transcription-dependent nucleolar cap localization and possible nuclear function of DExH RNA helicase RHAU. Exp Cell Res. Apr. 1, 2008;314(6):1378-91. doi: 10.1016/j.yexcr.2008.01.006. Epub Jan. 16, 2008.
Jacob et al. Intron retention as a component of regulated gene expression programs. Hum Genet 136:1043-1057 (2017).
Jarver, et al., 2014, "A Chemical View of Oligonucleotides for Exon Skipping and Related Drug Applications," Nucleic Acid Therapeutics 24(1): 37-47.
Jarver, P. et al., A Chemical View of Oligonucleotides for Exon Skipping and Related Drug Applications, Nucleic Acid Therapeutics vol. 24, No. (1), pp. 37-47, (2014).
Jearawiriyapaisarn, et al. Sustained Dystrophin Expression Induced by Peptide-conjugated Morpholino Oligomers in the Muscles of mdx Mice. Mol Ther. Sep. 2008; 16(9): 1624-1629.
Jurka et al. Identification of new medium reiteration frequency repeats in the genomes of Primates, Rodentia and Lagomorpha. Genetica98.3 (1996): 235-247.
Jurkiewicz, D. et al. Spectrum of JAG1 gene mutations in Polish patients with Alagille syndrome J. Appl. Genetics vol. 55, pp. 329-336, (2014).
Kach et al. A novel antisense oligonucleotide approach to treat eye diseases by increasing target gene expression. No. 3423-A0194 ARVO Poster Apr. 19, 2019 (1 pg.).
Kaminker, P.G., et al. A novel form of the telomere-associated protein TIN2 localizes to the nuclear matrix. Cell Cycle. 2009;8(6):931-9. PubMed PMID: 19229133; PubMed Central PMCID: PMC2751576.
Kang et al. Up-regulation of luciferase gene expression with antisense oligonucleotides: implications and applications in functional assay development. Biochemistry 37.18 (1998): 6235-6239.
Kaplan et al. Medium reiteration frequency repetitive sequences in the human genome. Nucleic acids research 19.17 (1991): 4731-4738.
Katsani, K.R. et al. Functional Genomics Evidence Unearths New Moonlighting Roles of Outer Ring Coat Nucleoporins Scientific Reports vol. 4, No. 4655 (Apr. 11, 2014).
Kawamata, N., et al. Genetic differences between Asian and Caucasian chronic lymphocytic leukemia. Int J Oncol. 2013;43(2):561-5. doi: 10.3892/ijo.2013.1966. PubMed PMID: 23708256; PubMed Central PMCID: PMC3775563.
Ke, et al. Quantitative evaluation of all hexamers as exonic splicing elements. Genome Res. Aug. 2011;21(8):1360-74. doi: 10.1101/gr.119628.110. Epub Jun. 9, 2011.
Keir, M.E. et al. PD-1 and Its Ligands in Tolerance and Immunity. Annu. Rev. Immunol. vol. 26, pp. 677-704 (2008).
Kervestin et al. NMD: a multifaceted response to premature translational termination. Nature reviews Molecular cell biology13.11 (2012): 700.
Kikin, et al. QGRS Mapper: a web-based server for predicting G-quadruplexes in nucleotide sequences. Nucleic Acids Res. Jul. 1, 2006;34(Web Server issue):W676-82.
Kim et al. The role of synaptic GTPase-activating protein in neuronal development and synaptic plasticity. J. Neurosci. 23(4):1119-1124 (Feb. 15, 2003).
Kim P., et al. ChimerDB 2.0—a knowledgebase for fusion genes updated. Nucleic Acids Res. 2009;38(Database issue):D81-5. Epub Nov. 13, 2009.doi: gkp982 [pii] 10.1093/nar/gkp982. PubMed PMID: 19906715.
Kim, E., et al. SRSF2 Mutations Contribute to Myelodysplasia by Mutant-Specific Effects on Exon Recognition. Cancer Cell. 2015;27(5):617-30. doi: 10.1016/j.ccell.2015.04.006. PubMed PMID: 25965569; PubMed Central PMCID: PMC4429920.
Kim, J. et al. The splicing factor U2AF65 stabilizes TRF1 protein by inhibiting its ubiquitin-dependent proteolysis. Biochem Biophys Res Commun. 2014;443(3):1124-30. doi: 10.1016/j.bbrc.2013.12.118. PubMed PMID: 24389012.
Knudsen et al. Increased skewing of X chromosome inactivation in Rett syndrome patients and their mothers. EurJ Hum Genet 14:1189-1194(2006).
Kole, et al. RNA therapeutics: beyond RNA interference and antisense oligonucleotides. Nat Rev Drug Discov. Jan. 20, 2012;11(2):125-40. doi: 10.1038/nrd3625.
Kralovicova et al. Exon-centric regulation of ATM expression is population-dependent and amenable to antisense modification by pseudoexon targeting, Scientific Reports, 6:18741, doi:10.1038/srep18741, Jan. 6, 2016 13 pages.
Kralovicova, et al. Allele-specific recognition of the 3' splice site of INS intron 1. Hum Genet. Oct. 2010;128(4):383-400. doi: 10.1007/s00439-010-0860-1. Epub Jul. 14, 2010.
Kralovicova, et al. Compensatory signals associated with the activation of human GC 5' splice sites. Nucleic Acids Res. Sep. 1, 2011;39(16):7077-91. doi: 10.1093/nar/gkr306. Epub May 23, 2011.
Kralovicova, et al. Global control of aberrant splice-site activation by auxiliary splicing sequences: evidence for a gradient in exon and intron definition. Nucleic Acids Res. Oct. 2007; 35(19): 6399-6413.
Kralovicova, et al. Identification of U2AF(35)-dependent exons by RNA-Seq reveals a link between 3' splice-site organization and activity of U2AF-related proteins. Nucleic Acids Res. Apr. 20, 2015;43(7):3747-63. doi: 10.1093/nar/gkv194. Epub Mar. 16, 2015.
Kralovicova, et al. Optimal antisense target reducing INS intron 1 retention is adjacent to a parallel G quadruplex. Nucleic Acids Res. Jul. 2014;42(12):8161-73. doi: 10.1093/nar/gku507. Epub Jun. 17, 2014.
Kralovicova, et al. Phenotypic consequences of branch point substitutions. Hum Mutat. Aug. 2006;27(8):803-13.
Kralovicova, et al. Position-dependent repression and promotion of DQB1 intron 3 splicing by GGGG motifs. J Immunol. Feb. 15, 2006;176(4):2381-8.
Kralovicova, et al. Variants in the human insulin gene that affect pre-mRNA splicing: is—23Hphl a functional single nucleotide polymorphism at IDDM2? Diabetes. Jan. 2006;55(1):260-4.
Kralovicova, et al., "Optimal antisense target reducing INS intron 1 retention is adjacent to a parallel G quadruplex" (2014) Nucleic Acids Research, v. 42, n. 12, p. 8161-8173.
Kralovicova, et al., "Exon-Centric Regulation of ATM expression is population-dependent and amenable to antisense modification by pseudoexon targeting", Scientific Reports (2016) p. 1-13.
Kralovicova, et al., "Global control of aberrant splice-site activation by auxiliary splicing sequences: evidence for a gradient in exon and intron definition", (2007) Nucleic Acids Research, v. 35, n. 19, p. 6399-6413.
Kralovicova, et al. Antisense Oligonucleotides Modulating Activation of a Nonsense-Mediated RNA Decay Switch Exon in the ATM Gene.Nucleic Acid Ther. Dec. 1, 2016; 26(6): 392-400.
Kralovicova, J. et al. Branch sites haplotypes that control alternative splicing. Hum Mol Genet. 2004;13:3189-202.

(56) References Cited

OTHER PUBLICATIONS

Kralovicova, J. et al. The role of short RNA loops in recognition of a single-hairpin exon derived from a mammalian-wide interspersed repeat. RNA Biol. 2015;12(1):54-69. doi: 10.1080/15476286.2015. 1017207. PubMed PMID: 25826413.

Kriaucionis et al. The major form of MeCP2 has a novel N-terminus generated by alternative splicing. Nucleic Acids Res 32:1818-1823 (2004).

Krishnaraj et al. RettBASE: Rett syndrome database update. Hum Mutat 38:922-931 (2017).

Lander, et al. Initial sequencing and analysis of the human genome. Nature, 409 (Feb. 15, 2001): 860-921.

LaPlanche et al. Phosphorothioate-modified oligodeoxyribonucleotides. III. NMR and UV spectroscoptc studies of thRp-Rp,Sp-Sp, anRp-Sduplexes, [d(GGsAATTCC)]2, derived from diastereomeriO-ethyl phosphorothioates Nucleic Acids Res. vol. 14, No. 22, pp. 9081-9093 (Nov. 25, 1986).

Le Gal, et al., "A case of SUDEP in a patient with Dravet syndrome with SCN1A mutation" (2010) Epilepsia, 5199): 1915-1918.

Le Hir, et al. How introns influence and enhance eukaryotic gene expression. Trends Biochem Sci. Apr. 2003;28(4):215-20.

Lee, E.S. et al. The Consensus 5' Splice Site Motif Inhibits mRNA Nuclear Export.PLoS One vol. 10, No. 3, p. e0122743 (Mar. 31, 2015).

Lee, J., et al. Metastasis of neuroendocrine tumors are characterized by increased cell proliferation and reduced expression of the ATM gene. PLoS ONE. 2012;7:e34456.

LeHir, H. et al. 5'-End RET Splicing: Absence of Variants in Normal Tissues and Intron Retention in Pheochromocytomas, Oncology 63:84-91 (2002).

Lei et al. Exonization of Alu Ya5 in the human ACE gene requires mutations in both 3' and 5' splice sites and is facilitated by a conserved splicing enhancer. Nucleic acids research 33.12 (2005): 3897-3906.

Lei, et al. Identification of splicing silencers and enhancers in sense Alus: a role for pseudoacceptors in splice site repression. Mol Cell Biol. Aug. 2005;25(16):6912-20.

Lemaire, M., et al. CDC25B phosphorylation by p38 and MK-2. Cell Cycle. 2006;5(15):1649-53. PubMed PMID: 16861915.

Lev-Maor et al. Intronic Alus influence alternative splicing. PLoS genetics 4.9 (2008): e1000204.

Lev-Maor et al. The birth of an alternatively spliced exon: 3'splice-site selection in Alu exons. Science 300.5623 (2003): 1288-1291.

Levy et al.TranspoGene and microTranspoGene: transposed elements influence on the transcriptome of seven vertebrates and invertebrates. Nucleic acids research 36.suppl_1 (2007): D47-D52.

Li et al. JAG1 Mutation Spectrum and Origin in Chinese Children with Clinical Features of Alagille Syndrome. PLoS One 10(6):e0130355 (2015).

Li et al. PD-L1—Driven Tolerance Protects Neurogenin3-Induced Islet Neogenesis to Reverse Established Type 1 Diabetes in NOD Mice.Diabetes vol. 64, pp. 529-540 (Feb. 2015; epub Oct. 20, 2014).

Liang et al. Short intronic repeat sequences facilitate circular RNA production. Genes & development (2014): gad-251926.

Liang, et al., "Translation efficiency of mRNAs is increased by antisnse oligonucleotides targeting upstream open reading frames" (2016) Nature Biotechnology, V. 34, N. 8, p. 875-882.

Liang, Xue-Hai et al., T ranslation efficiency of mRNAs is increased by antisense oligonucleotides targeting upstream open reading frames,Nature Biotechnology, 34(8):875-882 (Aug. 2016).

Lianoglou, S., et al. Ubiquitously transcribed genes use alternative polyadenylation to achieve tissue-specific expression. Genes Dev. 2013;27(21):2380-96. Epub Oct. 23, 2013.doi: gad.229328.113 [pii] 10.1101/gad.229328.113. PubMed PMID: 24145798.

Lim et al. A computational analysis of sequence features involved in recognition of short introns. Proceedings of the National Academy of Sciences98.20 (2001): 11193-11198.

Litchfield, D.W., et al. Pin1: Intimate involvement with the regulatory protein kinase networks in the global phosphorylation landscape. Biochem Biophys Acta. 2015. doi: 10.1016/j.bbagen.2015. 02.018. PubMed PMID: 25766872.

Liu et al. Alternative splicing and retinal degeneration. Clinical Genetics 84(2):142-149 (2013).

Llorian et al. Position-dependent alternative splicing activity revealed by global profiling of alternative splicing events regulated by PTB. Nature structural & molecular biology 17.9 (2010): 1114.

Lo, et al., "ATM has a major role in the double-strand break repair pathway dysregulation in sporadic breast carcinomas and is an independent prognostic marker at both mRNA and protein levels", (2015), Br J Cancer 112: 1059-1066.

Lo, et al., "ATM polymorphisms and risk of lung cancer among never smokers", (2010) Lund Cancer 69, p. 148-154.

Lo, YL et al. ATM Polymorphisms and risk of lung cancer among never smokers, Lung Cancer 69(2):148-154 (2010).

Long et al. Correction of diverse muscular dystrophy mutations in human engineered heart muscle by single-site genome editing. Sci Adv 4:eaap9004 (2018).

Lorenz, et al. 2D meets 4G: G-Quadruplexes in RNA Secondary Structure Prediction. IEEE/ACM Trans Comput Biol Bioinform. Jul.-Aug. 2013;10(4):832-44. doi: 10.1109/TCBB.2013.7.

Lu, F. Conditional JAG1 MutationShows the Developing Heart Is More Sensitive Than Developing Liver to JAG1 Dosage.Am. J. Hum. Genet. vol. 72, pp. 1065-1070 (2003).

Ludecke et al.Recessively inherited L-DOPA-responsive parkinsonism in infancy caused by a point mutation (L205P) in the tyrosine hydroxylase gene Hum. Mol. Genet. vol. 5, pp. 1023-1028, (1996).

Luo et al. Palmitic Acid Suppresses Apolipoprotein M Gene Expression via the Pathway of PPARb/d in HepG2 Cells. Biochemical and Biophysical Research Communications, 445(1):203-207 (Feb. 2014).

Magi-Galuzzi, C. et al. TMPRSS2-ERG gene fusion prevalence and class are significantly difference in prostate cancer of Caucasian, African-American and Japanese patients. The Prostate. 2011;71:489-97.

Makishima, et al. Mutations in the spliceosome machinery, a novel and ubiquitous pathway in leukemogenesis. Blood. Apr. 5, 2012;119(14):3203-10. doi: 10.1182/blood-2011-12-399774. Epub Feb. 9, 2012.

Maniatis et al. An extensive network of coupling among gene expression machines. Nature 416.6880 (2002): 499.

Mansouri, S. et al. Epstein-Barr Virus EBNA1 Protein Regulates Viral Latency through Effects on let-7 MicroRNA and Dicer.Journal of Virology, vol. 88, No. 19, pp. 11166-11177, (Oct. 2014).

Marcel, et al. G-quadruplex structures in TP53 intron 3: role in alternative splicing and in production of p53 mRNA isoforms. Carcinogenesis. Mar. 2011;32(3):271-8. doi: 10.1093/carcin/bgq253. Epub Nov. 26, 2010.

Marquez, Y. et al. Unmasking alternative splicing inside protein-coding exons defines exitrons and their role inproteome plasticity. Genome vol. 25, pp. 995-1007 (2015).

Matsuoka, S., et al. Ataxia telangiectasia-mutated phosphorylates Chk2 in vivo and in vitro. Proc Natl Acad Sci USA. 2000;97:10389-94.

Matsuoka, S., et al. ATM and ATR substrate analysis reveals extensive protein networks responsive to DNA damage. Science. 2007;316(5828):1160-6. Epub May 26, 2007.doi: 316/5828/1160 [pii] 10.1126/science.1140321. PubMed PMID: 17525332.

Mayeda, et al. Surveying cis-acting sequences of pre-mRNA by adding antisense 2'-O-methyl oligoribonucleotides to a splicing reaction. J Biochem. Sep. 1990;108(3):399-405.

Mckie et al. Mutations in the pre-mRNA splicing factor gene PRPC8 in autosomal dominant retinitis pigmentosa (RP13). Human Molecular Genetics 10(15):1555-1562 (2001).

Melhuish, et al. The Tgif2 gene contains a retained intron within the coding sequence, BMC Molecular Biology 7(2);1-10 (2006).

Melko, et al. Functional characterization of the AFF (AF4/FMR2) family of RNA-binding proteins: insights into the molecular pathology of FRAXE intellectual disability. Hum Mol Genet. May 15, 2011;20(10):1873-85. doi: 10.1093/hmg/ddr069. Epub Feb. 17, 2011.

Mendell, J.T., ap Rhys CM, Dietz HC. Separable roles for rent1/hUpf1 in altered splicing and decay of nonsense transcripts. Sci-

(56) References Cited

OTHER PUBLICATIONS ence. 2002;298(5592):419-22. Epub Sep. 14, 2002.doi: 10.1126/science.1074428 1074428 [pii]. PubMed PMID: 12228722.
Menzi, et al., "Towards Improved Oligonucleotide Therapeutics Through Faster Target Binding Kinetics", (2017) ChemPubSoc Europe, 23, p. 14221-14230.
Merendino, L., et al. Inhibition of msl-2 splicing by Sex-lethal reveals interaction between U2AF35 and the 3' splice site AG. Nature. 1999;402(6763):838-41. PubMed PMID: 10617208.
Michael, et al. Mfold web server for nucleic acid folding and hybridization prediction. Nucleic Acids Research. 31 (2003): 3406-3415.
Miller at al. 1993-2015 GeneReviews Eds. Pagon RA et al. Seattle (WA); University of WA, Seattle Bookshelf ID NBK1318.
Millevoi, et al. G-quadruplexes in RNA biology. Wiley Interdiscip Rev RNA. Jul.-Aug. 2012;3(4):495-507. doi: 10.1002/wrna.1113. Epub Apr. 4, 2012.
Min et al. Optimization of a novel series of ataxia-telangiectasia mutated kinase inhibitors as potential radiosensitizing agents. Journal of medicinal chemistry 59.2 (2016): 559-577.
Mirey, G., et al. CDC25B phosphorylated by pEg3 localizes to the centrosome and the spindle poles at mitosis. Cell Cycle. 2005;4(6):806-11. PubMed PMID: 15908796.
Mitelman, F., et al. The impact of translocations and gene fusions on cancer causation. Nat Rev Cancer. 2007;7(4):233-45. Epub Mar. 16, 2007.
Mnatzakanian et al. A previously unidentified MECP2 open reading frame defines a new protein isoform relevant to Rett syndrome. Nat Genet 36:339-341 (2004).
Mochizuki, T. et al. PKD2, a gene for polycystic kidney disease that encodes an integral membrane protein.Science vol. 272, pp. 1339-1342 (1996).
Montecucco, A., et al. Pre-mRNA processing factors meet the DNA damage response. Front Genet. 2013;4:102. doi: 10.3389/fgene.2013.00102. PubMed PMID: 23761808; PubMed Central PMCID: PMC3674313.
Moreno et al. Delivery of splice switching oligonucleotides by amphiphilic chitosan-based nanoparticles. Molecular pharmaceutics13.2 (2016): 344-356.
Morris, et al. An RNA G-quadruplex is essential for cap-independent translation initiation in human VEGF IRES. J Am Chem Soc. Dec. 22, 2010;132(50):17831-9. doi: 10.1021/ja106287x. Epub Nov. 24, 2010.
Morrison, A.J., et al. Mec1/Tel1 phosphorylation of the INO80 chromatin remodeling complex influences DNA damage checkpoint responses. Cell. 2007;130(3):499-511. doi: 10.1016/j.cell.2007.06.010. PubMed PMID: 17693258.
Moskowitz, et al., Mutation in Scheie syndrome (MPS IS): a G→A transition creates new splice site in intron 5 of one IDUA allele, Hum. Mutat. 2(2):141-144 (1993).
Mulley et al. A new molecular mechanism for severe myoclonic epilepsy of infancy: Exonic deletions in SCN1A.Neurol. vol. 67, pp. 1094-1095 (2006).
Mulley et al. SCN1A mutations and epilepsy.Hum. Muta. vol. 25, pp. 535-542 (2005).
Murray, S.F. et al. Allele-Specific Inhibition of Rhodopsin with an Antisense Oligonucleotide Slows Photoreceptor Cell Degeneration, Invest Ophthalmol. Vis. Sci. 56:6362-6375 (Oct. 2015).
Neidle, S. and Balasubramanian, S. (2006) Quadruplex Nucleic Acids. RSC Biomolecular Sciences, Cambridge, UK.
Nemeroff et al. Identification of cis-acting intron and exon regions in influenza virus NS1 mRNA that inhibit splicing and cause the formation of aberrantly sedimenting presplicing complexes. Molecular and cellular biology 12.3 (1992): 962-970.
Nguyen, L.A., et al. Physical and functional link of the leukemia-associated factors AML1 and PML. Blood. 2005;105(1):292-300. doi: 10.1182/blood-2004-3-1185. PubMed PMID: 15331439.
Nishi, M. et al. Insulin gene mutations and diabetes. Journal of Diabetes Investigation vol. 2 Issue 2 (Apr. 2011).
Nishida, A. et al. Tissue- and Case-specific retention of intron 40 in mature dystrophin mRNA, Journal of Human Genetic 60;327-333 (2015).
Nisole, S., et al. Differential Roles of PML Isoforms. Front Oncol. 2013;3:125. doi: 10.3389/fonc.2013.00125. PubMed PMID: 23734343; PubMed Central PMCID: PMC3660695.
Nomakuchi et al. Antisense-oligonucleotide-directed inhibition of nonsense-mediated mRNA decay. Nat. Biotechnol. 34(2):164-166 (Feb. 2016).
Nozu et al. Alport syndrome caused by a COL4A5 deletion and exonization of an adjacent AluY. Molecular genetics & genomic medicine 2.5 (2014): 451-453.
Nussinov. Conserved quartets near 5' intron junctions in primate nuclear pre-mRNA. J Theor Biol. Jul. 8, 1988;133(1):73-84.
Oda, T. et al. Identification and cloning of the human homolog (JAG) of the rat Jagged1 gene from the Alagille syndrome critical region at 20p12.Genomics vol. 43, No. 3, pp. 376-379 (1997).
Okazaki, T. et al. PD-1 and PD-1 ligands: from discovery to clinical application. International Immunology(The Japanese Society for Immunology), vol. 19, No. 7, pp. 813-824, (2007).
Oustric, V. et al. Antisense oligonucleotide-based therapy in human erythropoietic protoporphyria. Am J Hum Genet. 2014;94(4):611-7. doi: 10.1016/j.ajhg.2014.02.010. PubMed PMID: 24680888; PubMed Central PMCID: PMC3980518.
Pacheco, et al. Diversity of vertebrate splicing factor U2AF35: identification of alternatively spliced U2AF1 mRNAS. J Biol Chem. Jun. 25, 2004;279(26):27039-49. Epub Apr. 19, 2004.
Pacheco, et al. RNA interference knockdown of hU2AF35 impairs cell cycle progression and modulates alternative splicing of Cdc25 transcripts. Mol Biol Cell. Oct. 2006;17(10):4187-99. Epub Jul. 19, 2006.
Page-McCaw, P.S., et al. PUF60: a novel U2AF65-related splicing activity. RNA. 1999;5(12):1548-60. PubMed PMID: 10606266.
Palazzo et al. Non-coding RNA: what is functional and what is junk?. Frontiers in genetics 6 (2015): 2.
Pandit et al. Genome-wide analysis reveals SR protein cooperation and competition in regulated splicing. Molecular cell 50.2 (2013): 223-235.
Papaemmanuil, et al. Clinical and biological implications of driver mutations in myelodysplastic syndromes. Blood. Nov. 21, 2013;122(22):3616-27; quiz 3699. doi: 10.1182/blood-2013-08-518886. Epub Sep. 12, 2013.
Passamonti, C. et al. A novel inherited SCN1A mutation associated with different neuropsychological phenotypes: Is there a common core deficit? Epilepsy & Behavior 43:89-92 (2015).
Pastor, et al. Interaction of hnRNPA1/A2 and DAZAP1 with an Alu-derived intronic splicing enhancer regulates ATM aberrant splicing. PLoS One. 2011;6(8):e23349. doi: 10.1371/journal.pone.0023349. Epub Aug. 8, 2011.
Pastor, F., et al. Induction of tumour immunity by targeted inhibition of nonsense-mediated mRNA decay. Nature. 2010;465(7295):227-30. doi: 10.1038/nature08999. PubMed PMID: 20463739; PubMed Central PMCID: PMC3107067.
Paz, A., et al. SPIKE: a database of highly curated human signaling pathways. Nucleic Acids Res. 2011;39(Database issue):D793-9. doi: 10.1093/nar/gkq1167. PubMed PMID: 21097778; PubMed Central PMCID: PMC3014840.
Pear, Warren S. New roles for Notch in tuberous sclerosis, Journal of Clinical Investigation, 120(1):84-87 (Jan. 4, 2010).
Pecarelli et al. Regulation of natural mRNAs by the nonsense-mediated mRNA decay pathway. Eukaryotic cell(2014): EC-00090.
Pellagatti, A., et al. Deregulated gene expression pathways in myelodysplastic syndrome hematopoietic stem cells. Leukemia. 2010;24(4):756-64. doi: 10.1038/leu.2010.31. PubMed PMID: 20220779.
Peng, et al. Functional importance of different patterns of correlation between adjacent cassette exons in human and mouse. BMC Genomics. Apr. 26, 2008;9:191. doi: 10.1186/1471-2164-9-191.
Penton, A.L.Notch signaling in humandevelopment and disease. Seminars in Cell & Developmental Biology. vol. 23, pp. 450-457 (2012).

(56) References Cited

OTHER PUBLICATIONS

Perdiguero, E., et al. Regulation of Cdc25C activity during the meiotic G2/M transition. Cell Cycle. 2004;3(6):733-7. PubMed PMID: 15136768.

Piaceri, I., et al. Ataxia-telangiectasia mutated (ATM) genetic variant in Italian centenarians. Neurophysiology. 2013;34:573-5.

Pilia et al. Jagged-1 mutation analysis in Italian Alagille syndrome patients. Hum Mut 14(5):394-400 (1999).

Pomentel et al. A dynamic intron retention program enriched in RNA processing genes regulates gene expression during terminal erythropoiesis. Nucleic acids research 44.2 (2015): 838-851.

Precursor mRNA-Processing Factor 3, S. Cerevisiae, Homolog of; PRPF3m, 3 pages.

Przychodzen, B., et al. Patterns of missplicing due to somatic U2AF1 mutations in myeloid neoplasms. Blood. 2013;122:999-1006. Epub Jun. 19, 2013.doi: blood-2013-01-480970 [pii] 10.1182/blood-2013-01-480970. PubMed PMID: 23775717.

Pugliese, et al. The insulin gene is transcribed in the human thymus and transcription levels correlated with allelic variation at the INS VNTR-IDDM2 susceptibility locus for type 1 diabetes. Nat Genet. Mar. 1997;15(3):293-7.

Raghavan, et al., "The spliceosomal U1 snRNP component Mud1 is autoregulated by promoting premature cleavage and polyadenylation of its own transcript, The Nineteenth Annual Meeting of the Rna Society".

Rainey et al. Transient inhibition of ATM kinase is sufficient to enhance cellular sensitivity to ionizing radiation. Cancer research68. 18 (2008): 7466-7474.

Ramocki et al. The MECP2 duplication syndrome. Am J Med Genet A 152A:1079-1088 (2010).

Rangasamy et al. Reduced neuronal size and mTOR pathway activity in the Mecp2 A140V Rett syndrome mouse model. F1000research 5:2269 (2016).

Ray, D. et al. A compendium of RNA-binding motifs for decoding gene regulation. Nature. vol. 499, No. 7457, pp. 172-177 (Jul. 11, 2013).

Reineke, E.L., et al. Degradation of the tumor suppressor PML by Pin1 contributes to the cancer phenotype of breast cancer MDA-MB-231 cells. Mol Cell Biol. 2008;28(3):997-1006. doi: 10.1128/MCB.01848-07. PubMed PMID: 18039859; PubMed Central PMCID: PMC2223389.

Rendu, J. et al. Hum Gene Ther. Exon skipping as a therapeutic strategy applied to an RYR1 mutation with pseudo-exon inclusion causing a severe core myopathy. Jul. 2013;24(7):702-13. doi: 10.1089/hum.2013.052.

Reynolds, DM et al.Aberrant Splicing in the PKD2 Gene as a Cause of Polycystic Kidney Disease.Am. Soc. Nephrol. vol. 10, pp. 2342-2351 (1999).

Ritprajak et al. Keratinocyte-Associated B7-H1 Directly Regulates Cutaneous Effector CD8+ T Cell Responses.J Immunology vol. 184, pp. 4918-4925 (2010).

RNA 2-14 The Nineteenth Annual Meeting of the RNA Society. Quebec City, Canada. (Jun. 3-8, 2014).

Roberts, Jennifer et al. Efficient and Persistent Splice Switching by Systemically Delivered LNA Oligonucleotides in Mice. Molecular Therapy, Nature Publishing, vol. 14, No. 4, pp. 471-475, Oct. 1, 2006.

Romero, P.R., et al. Alternative splicing in concert with protein intrinsic disorder enables increased functional diversity in multicellular organisms. Proc Natl Acad Sci USA. 2006;103(22):8390-5. Epub May 24, 2006.doi: 0507916103 [pii] 10.1073/pnas.0507916103. PubMed PMID: 16717195.

Rosenbloom et al. The UCSC Genome Browser database: 2015 Update. Nucleic Acids Research 43, Database Issue doi:101093/nar/gku1177.

Rosenbloom, et al., 2015, "The UCSC Genome Browser database: 2015 update," Nucleic Acids Research 43, Database Issue, doi: 10.1093/nar/.

Ruchlemer, R., et al. Geography, ethnicity and "roots" in chronic lymphocytic leukemia. Leuk Lymphoma. 2013;54(6):1142-50. doi: 10.3109/10428194.2012.740670. PubMed PMID: 23121522.

Rudd, M.F., et al. Variants in the ATM-BRCA2-CHEK2 axis predispose to chronic lymphocytic leukemia. Blood. 2006;108(2):638-44. Epub Apr. 1, 2006.doi: 2005-12-5022 [pii] 10.1182/blood-2005-12-5022. PubMed PMID: 16574953.

Ruskin, et al. A factor, U2AF, is required for U2 snRNP binding and splicing complex assembly. Cell. Jan. 29, 1988;52(2):207-19.

S. M. Berge, et al., J. Pharmaceutical Sciences, 66: 1-19 (1977).

Sadleir, et al. Not all SCN1A epileptic encephalopathies are Dravet syndrome. Neurology. Sep. 5, 2017; 89(10): 1-8.

Sahashi et al. Pathological impact of SMN2 mis-splicing in adult SMA mice. EMBO Mol. Med. 5(10):1586-601 (Oct. 2013).

Sahashi et al. TSUNAMI: an antisense method to phenocopy splicing-associated diseases in animals. Genes Dev. 26(16):1874-1884 (Aug. 15, 2012).

Sakabe, et al. Sequence features responsible for intron retention in human. BMC Genomics. Feb. 26, 2007;8:59.

Samatanga, et al. The high kinetic stability of a G-quadruplex limits hnRNP F qRRM3 binding to G-tract RNA. Nucleic Acids Res. Feb. 1, 2013;41(4):2505-16. doi: 10.1093/nar/gks1289. Epub Dec. 28, 2012.

Sazani, et al., "Splice Switching Oligonucleotides as Potential Therapeutics", Antisense Drug Technology, Second Edition, p. 90-114.

Schanen et al. A Severely Affected Male Born into a Rett Syndrome Kindred Supports X-Linked Inheritance and Allows Extension of the Exclusion Map. Am J Hum Genetics 63:267-269 (1998).

Schwarze, et al. Redefinition of exon 7 in the COL1A1 gene of type I collagen by an intron 8 splice-donor-site mutation in a form of osteogenesis imperfecta: influence of intron splice order on outcome of splice-site mutation. Am J Hum Genet. Aug. 1999;65(2):336-44.

Scott, S.P., et al. Missense mutations but not allelic variants alter the function of ATM by dominant interference in patients with breast cancer. Proc Natl Acad Sci USA. 2002;99:925-30.

SG 11201702682P Search Report and Written Opinion dated Apr. 9, 2018.

Shao, C., et al. Mechanisms for U2AF to define 3' splice sites and regulate alternative splicing in the human genome. Nat Struct Mol Biol. 2014;doi: 10.1038/nsmb.2906.

Shcherbakova, I., et al. Alternative spliceosome assembly pathways revealed by single-molecule fluorescence microscopy. Cell Rep. 2013;5(1):151-65. Epub Oct. 1, 2013.doi: S2211-1247(13)00467-1 [pii] 10.1016/j.celrep.2013.08.026. PubMed PMID: 24075986.

Shen, M., et al. Characterization and cell cycle regulation of the related human telomeric proteins Pin2 and TRF1 suggest a role in mitosis. Proc Natl Acad Sci USA. 1997;94(25):13618-23. PubMed PMID: 9391075; PubMed Central PMCID: PMC28355.

Shiloh, Y., et al The ATM protein kinase: regulating the cellular response to genotoxic stress, and more. Nat Rev Mol Cell Biol. 2013;14(4):197-210. doi: 10.1038/nrm3546. PubMed PMID: 23486281.

Shiria, C.L. et al. Mutant U2AF1 Expression Alters Hematopoiesis and Pre-mRNA Splicing In Vivo. Cancer Cell. 2015;27(5):631-43. doi: 10.1016/j.ccell.2015.04.008. PubMed PMID: 25965570; PubMed Central PMCID: PMC4430854.

Shirley, M.H., et al Incidence of haematological malignancies by ethnic group in England, Jul. 2001. Br J Haematol. 2013;163(4):465-77. doi: 10.1111/bjh.12562. PubMed PMID: 24033296.

Sierakowska, H et al. Repair of thalassemic human beta-globin mRNA in mammalian cells by antisense oligonucleotides. Proc Natl Acad Sci U S A. Nov. 12, 1996;93(23):12840-4.

Singh, et al. An antisense microwalk reveals critical role of an intronic position linked to a unique long-distance interaction in pre-mRNA splicing. RNA. Jun. 2010;16(6):1167-81. doi: 10.1261/rna.2154310. Epub Apr. 22, 2010.

Sirand-Pugnet, et al. An intronic (A/U)GGG repeat enhances the splicing of an alternative intron of the chicken beta-tropomyosin pre-mRNA. Nucleic Acids Res. Sep. 11, 1995;23(17):3501-7.

Skjevik et al. The N-Terminal Sequence of Tyrosine Hydroxylase is a Conformationally Versatile Motif That Binds 14-3-3 Proteins and Membranes.J. Mol. Bio. vol. 426, pp. 150-168 (2014).

Smith AF, Hubley R. and Green P. (1996). RepeatMasker Open-3.0.

(56) References Cited

OTHER PUBLICATIONS

Smith, C.W., et al. Scanning and competition between AGs are involved in 3' splice site selection in mammalian introns. Mol Cell Biol. 1993;13(8):4939-52. PubMed PMID: 8336728.
Smith, et al. Alternative pre-mRNA splicing: the logic of combinatorial control. Trends Biochem Sci. Aug. 2000;25(8):381-8.
Smith, P.J., et al. An increased specificity score matrix for the prediction of SF2/ASF-specific exonic splicing enhancers. Hum Mol Genet. 2006;15(16):2490-508. PubMed PMID: 16825284.
Soo, R.A., et al. Ethnic differences in survival outcome in patients with advanced stage non-small cell lung cancer. J Thorac Oncol. 2011;6:1030-8.
Sorek et al. Minimal conditions for exonization of intronic sequences: 5' splice site formation in alu exons. Molecular cell 14.2 (2004): 221-231.
Soutar et al. Mechanisms of disease: genetic causes of familial hpercholesterolemia. Nat. Clin. Pract. Cardiovasc. Med. 4:214-255 (Apr. 1, 2007).
Spellman et al. Regulation of alternative splicing by PTB and associated factors. (2005): 457-460.
Spinner et al. Jagged1 mutations in alagille syndrome. Hum Mutat 17(1):18-33 (2001).
Stamm, S. Regulation of alternative splicing by reversible protein phosphorylation. J Biol Chem. 2008;283(3):1223-7. PubMed PMID: 18024427.
Stankovic, T., et al. Inactivation of ataxia telangiectasia mutated gene in B-cell chronic lymphocytic leukaemia. Lancet. 1999;353(9146):26-9. doi: 10.1016/S0140-6736(98)10117-4. PubMed PMID: 10023947.
Staropoli et al. Rescue of gene-expression changes in an induced mouse model of spinal muscular atrophy by an antisense oligonucleotide that promotes inclusion of SMN2 exon 7. Genomics 105:220-228 (2015).
Stead, et al. Global haplotype diversity in the human insulin gene region. Genome Res. Sep. 2003;13(9):2101-11.
Stec et al. Automated solid-phase synthesis, separation, and stereochemistry of phosphorothioate analogs of oligodeoxyribonucleotides J. Am. Chem. Soc., 1984, 106 (20), pp. 6077-6079 (1984).
Stein et al. FDA-Approved Oligonucleotide Therapies in 2017. Mol Ther 25:1069-1075 (2017).
Stein et al. Physicochemical properties of phosphorothioate oligodeoxynucleotides. Nucleic Acids Res. Apr. 25, 1988;16(8):3209-21.
Story, M.D. et al. ATM has a major role in the double-stand break repair pathway dysregulation in sporadic breast carcinomas and is an independent prognostic marker at both mRNA and protein levels, Breast Diseases: A Yearbook Quarterly, 26(4);297-299 (Mar. 17, 2015).
Strausfeld, U., et al. Activation of p34cdc2 protein kinase by microinjection of human cdc25C into mammalian cells. Requirement for prior phosphorylation of cdc25C by p34cdc2 on sites phosphorylated at mitosis. J Biol Chem. 1994;269(8):5989-6000. PubMed PMID: 8119945.
Suarez, F. et al. Incidence, presentation, and prognosis of malignancies in ataxia-telangiectasia: a report from the French national registry of primary immune deficiencies. J Clin Oncol. 2015;33(2):202-8. doi: 10.1200/JCO.2014.56.5101. PubMed PMID: 25488969.
Summerton, James. Morpholino Antisense Oligos: Applications in Biopharmaceutical ResearchMorpholinos constitute a radical redesign of DNA, providing decisive advantages over the moreconventional oligo types used for modulating gene expression. Innovations in Pharmaceutical Technology Issue No. 17 (2005).
Sun, H., et al. Multiple splicing defects in an intronic false exon. Mol Cell Biol. 2000;20(17):6414-25. PubMed PMID: 10938119.
Supplementary European Search Report dated Apr. 18, 2019 for EP16876615.2.
Svasti, et al. RNA repair restores hemoglobin expression in IVS2-654 thalassemic mice. Proc Natl Acad Sci U S A. Jan. 27, 2009; 106(4): 1205-1210.

Swaans, RJM et al.Four novel mutations in the Tyrosine Hydroxylase gene in patients with infantile parkinsonism Annals of Human Genetic, vol. 64, No. 1, pp. 25-31, (Jan. 2000).
Tabrez, S. et al. A Synopsis of the Role of Tyrosine Hydroxylase in Parkinson's Disease.CNS & Neurological Disorders—Drug Targets vol. 11, No. 4 (2012).
Takahashi et al. Skewed X chromosome inactivation failed to explain the normal phenotype of a carrier female with MECP2 mutation resulting in Rett syndrome. Clin Genet 73:257-261 (2008).
Tavanez, J.P., et al. hnRNP A1 proofreads 3' splice site recognition by U2AF. Mol Cell. 2012;45(3):314-29. Epub Feb. 14, 2012. doi: S1097-2765(12)00032-9 [pii] 10.1016/j.molcel.2011.11.033. PubMed PMID: 22325350.
Taylor, A.M., et al. Ataxia telangiectasia: more variation at clinical and cellular levels. Clin Genet. 2015;87(3):199-208. doi: 10.1111/cge.12453. PubMed PMID: 25040471.
Taylor, A.M., et al. Leukemia and lymphoma in ataxia telangiectasia. Blood. 1996;87(2):423-38. PubMed PMID: 8555463.
Thisted, et al. Optimized RNA targets of two closely related triple KH domain proteins, heterogeneous nuclear ribonucleoprotein K and alphaCP-2KL, suggest Distinct modes of RNA recognition. J Biol Chem. May 18, 2001;276(20):17484-96. Epub Feb. 2, 2001.
Tilgner et al. Deep Sequencing of subcellular RNA factions shows splicing to be predominantly co-transcriptional in the human genome but inefficient for IncRNAs.Genome Research vol. 22, No. 9, pp. 1616-1625 (2012).
Tillotson et al. Radically truncated MeCP2 rescues Rett syndrome-like neurological defects. Nature 550:398 (2017).
Torres, V.E. et al. Autosomal dominant polycystic kidney disease: the last 3 years.Kidney International vol. 76, pp. 149-168 (May 20, 2009).
Trabattoni, M. et al.Costimulatory Pathways in Multiple Disease Sclerosis: Distinctive Expression of PD-1 and PD-L1 in Patients with Different Patterns of Disease.J. Immunol. vol. 183, pp. 4984-4993 (2009).
Trapnell, C. et al. Differential gene and transcript expression analysis of RNA-seq experiments with Top Hat and Cufflinks. Nat Protoc. 2012;7(3):562-78. Epub Mar. 3, 2012.doi: nprot.2012.016 [pii] 10.1038/nprot.2012.016. PubMed PMID: 22383036.
Turnpenny, P.D. et al. Alagille syndrome: pathogenesis, diagnosis and management.European Journal of Human Genetics vol. 20, pp. 251-257 (2012.
U.S. Appl. No. 14/741,071 Non-Final Office Action dated Dec. 1, 2016.
U.S. Appl. No. 14/741,071 Notice of Allowability dated May 12, 2017.
U.S. Appl. No. 14/874,420 Non-Final Office Action dated Mar. 21, 2017.
U.S. Appl. No. 15/148,303 Notice of Allowance dated Jun. 7, 2017.
U.S. Appl. No. 14/395,780.
U.S. Appl. No. 14/874,420 Notice of Allowance dated Jan. 11, 2018.
U.S. Appl. No. 14/874,420 Office Action dated Oct. 24, 2017.
U.S. Appl. No. 15/619,984 Office Action dated Dec. 17, 2018.
U.S. Appl. No. 15/949,902 Office Action dated Mar. 1, 2019.
U.S. Appl. No. 15/288,415 Office Action dated Jun. 26, 2018.
Uhlmann, E. et al. Antisense oligonucleotides: a new therapeutic principle. Chemical Reviews vol. 90, No. 4, pp. 543-584 (Jun. 1990).
Vafiadis, et al. Insulin expression in human thymus is modulated by INS VNTR alleles at the IDDM2 locus. Nat Genet. Mar. 1997;15(3):289-92.
Van Nostrand et al. Robust transcriptome-wide discovery of RNA-binding protein binding sites with enhanced CLIP (eCLIP). Nature methods 13.6 (2016): 508.
Van Wart, et al., "Imparied Firing an dCell-Specific compensation in Neurons Lacking Navv1.6 sodium Channels" The Journal of Neuroscience, (2006), 26(27):7172-7180.
Verhaart, I.E.C. AON-Mediated Exon Skipping for Duchenne Muscular Dystrophy. Chapter 3. pp. 1-26 (Aug. 1, 2012).
Verret et al., Inhibitory Interneuron Deficit Links Altered Network Activity and Cognitive Dysfunction in Alzheimer Model, Cell, 149(3): 708-721 (2012).

(56) References Cited

OTHER PUBLICATIONS

Vickers, et al., "Fully modified 2' MOE oligonucleotides redirect polyadenylation", Isis Pharmaceuticals, Department of Molecular and Structural Biology, Nucleic Acids Research, 2001, vol. 29, No. 6 p. 1293-1299.
Vieira, N. et al. Jagged 1Rescues the Duchenne Muscular Dystrophy Phenotype. Cell vol. 163, pp. 1204-1213 (Nov. 19, 2015).
Voelker, et al. A comprehensive computational characterization of conserved mammalian intronic sequences reveals conserved motifs associated with constitutive and alternative splicing. Genome Res. Jul. 2007;17(7):1023-33. Epub May 24, 2007.
Vorechovsky Correspondence Pediatric Research 2010.
Vorechovsky Transposable elements in disease-associated cryptic exons. Human genetics 127.2 (2010): 135-154. 0.
Vorechovsky, I. Letter to the Editor: MER91B-assisted cryptic exon activation in Gitelman syndrome. Pediatric research 67.4 (2010): 444-445.
Wahl, et al. The spliceosome: design principles of a dynamic RNP machine. Cell. Feb. 20, 2009;136(4):701-18. doi: 10.1016/j.cell. 2009.02.009.
Wan et al.Synthesis, biophysical properties and biological activity of second generation antisense oligonucleotides containing chiral phosphorothioate linkages.Nucleic Acids Research, vol. 42, No. 22, pp. 13456-13468 (2014).
Wan, et al., 2014, "Synthesis, biophysical properties and biological activity of second generation antisense oligonucleotides containing chiral phosphorothioate linkages," Nucleic Acids Research 42(22): 13456-13468.
Wang et al. Alternative isoform regulation in human tissue transcriptomes. Nature. 2008;456(November):470-476.
Wang et al. Human Adenovirus Type 36 Enhances Glucose Uptake in Diabetic and Nondiabetic Human Skeletal Muscle Cells Independent of Insulin Signaling.Diabetes vol. 57, pp. 1861-1869 (2008).
Wang, et al. A complex network of factors with overlapping affinities represses splicing through intronic elements. Nat Struct Mol Biol. Jan. 2013;20(1):36-45. doi: 10.1038/nsmb.2459. Epub Dec. 16, 2012.
Wang, et al. Intronic splicing enhancers, cognate splicing factors and context-dependent regulation rules. Nat Struct Mol Biol. Oct. 2012;19(10):1044-52. doi: 10.1038/nsmb.2377. Epub Sep. 16, 2012.
Wang, et al. Regulation of insulin preRNA splicing by glucose. Proc Natl Acad Sci U S A. Apr. 29, 1997;94(9):4360-5.
Wang, Z. et al. Systematic identification and analysis of exonic splicing silencers. Cell. 2004;119(6):831-45. PubMed PMID: 15607979.
Warf, M.B., et al. Role of RNA structure in regulating pre-mRNA splicing. Trends Biochem Sci. 2010;35(3):169-78. Epub Dec. 5, 2009.doi: S0968-0004(09)00196-0 [pii].
Weiss, et al., "Sodium channels SCN1A, SCN2A, SCN3A in familial autism", (2003) 8, p. 186-194.
Wieland, et al. RNA quadruplex-based modulation of gene expression. Chem Biol. Jul. 2007;14(7):757-63.
Wilton, et al. Splice modification to restore functional dystrophin synthesis in Duchenne muscular dystrophy. Current pharmaceutical design 16.8 (2010): 988-1001.
Wong et al. Orchestrated intron retention regulates normal granulocyte differentiation. Cell 154.3 (2013): 583-595.
Wu et al. AT-AC Pre-mRNA Splicing Mechanisms and Conservation of Minor Introns in Voltage-Gated Ion Channel Genes. Molecular and Cellular Biology 19(5): 3225-3236 (May 1999).
Wu, J.Y., et al. Specific interactions between proteins implicated in splice site selection and regulated alternative splicing. Cell. 1993;75(6):1061-70. Epub Dec. 17, 1993.doi: 0092-8674(93)90316-I [pii]. PubMed PMID: 8261509.
Wu, S. et al. Functional recognition of the 3' splice site AG by the splicing factor U2AF35.Nature. 1999;402(6763):832-5. PubMed PMID: 10617206.
Wu, Y. et al. MRE11-RAD50-NBS1 and ATM function as co-mediators of TRF1 in telomere length control. Nat Struct Mol Biol. 2007;14(9):832-40. doi: 10.1038/nsmb1286. PubMed PMID: 17694070.
Xia, Y. et al. Frequencies of SF3B1, NOTCH1, MYD88, BIRC3 and IGHV mutations and TP53 disruptions in Chinese with chronic lymphocytic leukemia: disparities with Europeans. Oncotarget. 2015;6(7):5426-34. PubMed PMID: 25605254.
Xing, et al. The multiassembly problem: reconstructing multiple transcript isoforms from EST fragment mixtures. Genome Res. Mar. 2004;14(3):426-41. Epub Feb. 12, 2004.
Yamamoto et al. Mib-Jag1-Notch signalling regulates patterning and structural roles of the notochord by controlling cell-fate decisions. Development 137(15):2527-2537 (2010).
Yamamoto, Y., et al. BCOR as a novel fusion partner of retinoic acid receptor alpha in a t(X;17)(p11;q12) variant of acute promyelocytic leukemia. Blood. 2010;116(20):4274-83. doi: 10.1182/blood-2010-01-264432. PubMed PMID: 20807888.
Yan, et al. Systematic discovery of regulated and conserved alternative exons in the mammalian brain reveals NMD modulating chromatin regulators. Proc Natl Acad Sci U S A. Mar. 17, 2015; 112(11): 3445-3450.
Yan, et al., "Systematic discovery of regulated and conserved alternative exons in the mammalian brain reveals NMD modulating chromatin regulators", (2015), PNAS, v. 112, n. 11, p. 3445-3450.
Yang et al. Biophysical analysis and small-angle X-ray scattering-derived structures of MeCP2-nucleosome complexes. Nucleic Acids Res 39:4122-4135 (2011).
Yang, S. et al. PML-dependent apoptosis after DNA damage is regulated by the checkpoint kinase hCds1/Chk2. Nat Cell Biol. 2002;4(11):865-70. doi: 10.1038/ncb869. PubMed PMID: 12402044.
Yang, S., et al. Promyelocytic leukemia activates Chk2 by mediating Chk2 autophosphorylation. J Biol Chem. 2006;281(36):26645-54. doi: 10.1074/jbc.M604391200. PubMed PMID: 16835227.
Yang, Y. et al.Oligomerization of the polycystin-2 C-terminal tail and effects on its Ca2+binding properties.J. Bio. Chem. vol. 290, No. 16, pp. 10544-10554 (2015).
Yeo, et al. Discovery and analysis of evolutionarily conserved intronic splicing regulatory elements. PLoS Genet. May 25, 2007;3(5):e85. Epub Apr. 13, 2007.
Yoshida, et al. Frequent pathway mutations of splicing machinery in myelodysplasia. Nature. Sep. 11, 2011;478(7367):64-9. doi: 10.1038/nature10496.
Yoshida, K., et al. Splicing factor mutations and cancer. Wiley Interdiscip Rev RNA. 2014;5(4):445-59. doi: 10.1002/wrna.1222. PubMed PMID: 24523246.
Young et al. 915—a GABA-Selective AAV Vector-Based Approach to Up-Regulate Endogenous Scn1a Expression reverses key Phenotypes in a Mouse Model of Dravet Syndrome. 22nd Annual Meeting American Society of Gene & Cell Therapy. Washington, D.C. Apr. 29-May 2, 2019 (Abstract).
Yu, E.Y., et al. Regulation of telomere structure and functions by subunits of the INO80 chromatin remodeling complex. Mol Cell Biol. 2007;27(16):5639-49. doi: 10.1128/MCB.00418- 07. PubMed PMID: 17562861; PubMed Central PMCID: PMC1952117.
Yuan et al. Brain localization and neurotoxicity evaluation of polysorbate 80-modified chitosan nanoparticles in rats. PloS one 10.8 (2015): e0134722.
Yuan X., et al. Nuclear protein profiling of Jurkat cells during heat stress-induced apoptosis by 2-DE and MS/MS. Electrophoresis. 2007;28(12):2018-26. doi: 10.1002/elps.200600821. PubMed PMID: 17523140.
Zamore, P.D., et al. Identification, purification, and biochemical characterization of U2 small nuclear ribonucleoprotein auxiliary factor. Proc Natl Acad Sci USA. 1989;86(23):9243-7. PubMed PMID: 2531895.
Zarnack K., et al. Direct competition between hnRNP C and U2AF65 protects the transcriptome from the exonization of Alu elements. Cell. 2013;152(3):453-66. Epub Feb. 5, 2013.doi: S0092-8674(12)01545-0 [pii] 10.1016/j.cell.2012.12.023. PubMed PMID: 23374342.
Zhang C., et al. RNA landscape of evolution for optimal exon and intron discrimination. Proc Natl Acad Sci USA. 2008;105(15):5797-802. Epub Apr. 9, 2008.doi: 0801692105 [pii] 10.1073/pnas. 0801692105. PubMed PMID: 18391195.

(56) References Cited

OTHER PUBLICATIONS

Zhang, et al. Insulin as an autoantigen in NOD/human diabetes. Curr Opin Immunol. Feb. 2008;20(1):111-8. doi: 10.1016/j.coi.2007.11.005.

Zhang, et al. The kinetics and folding pathways of intramolecular G-quadruplex nucleic acids. J Am Chem Soc. Nov. 21, 2012;134(46):19297-308. doi: 10.1021/ja309851t. Epub Nov. 12, 2012.

Zhang, J. et al. PowerBLAST: A New Network BLAST Application for Interactive or Automated Sequence Analysis and Annotation Genome Res., vol. 7, pp. 649-656, (1997).

Zhang, X.H., et al. Computational definition of sequence motifs governing constitutive exon splicing. Genes Dev. 2004;18:1241-50. PubMed PMID: 15145827.

Zimrin et al. An Antisense Oligonucleotide to the Notch Ligand Jagged Enhances Firbroblast Growth Factor-induced Angiogenesis in Vitro. J. Biol. Chem. 271(51):32499-502 (Dec. 20, 1996).

Zon et al. Phosphorothioate oligonucleotides: chemistry, purification, analysis, scale-up and future directions. Anti Cancer Drug Design vol. 6, No. 6, pp. 539-568 (1991).

Zon G. and Stec,W.J. (1991) in Eckstein,F. (ed.), Oligonucleotides and Analogues: A Practical Approach. Oxford University Press, Oxford, UK, pp. 87-108.

Zorio, D.A., et al. Both subunits of U2AF recognize the 3' splice site in Caenorhabditis elegans. Nature. 1999;402(6763):835-8. PubMed PMID: 10617207.

Zuker, M. Mfold web server for nucleic acid folding and hybridization prediction. Nucleic Acids Res. 31, 3406-3415 (2003).

\* cited by examiner

FIG. 4

Sodium voltage-gaited channel alpha subunit

| Gene | Approved Name | Chromosome | |
|---|---|---|---|
| SCN1A | sodium voltage-gated channel alpha subunit 1 | 2q24.3 | ⬅ |
| SCN2A | sodium voltage-gated channel alpha subunit 2 | 2q24.3 | ⬅ |
| SCN3A | sodium voltage-gated channel alpha subunit 3 | 2q24.3 | ⬅ |
| SCN7A | sodium voltage-gated channel alpha subunit 7 | 2q24.3 | X |
| SCN8A | sodium voltage-gated channel alpha subunit 8 | 12q13.13 | ⬅ |
| SCN9A | sodium voltage-gated channel alpha subunit 9 | 2q24.3 | ⬅ |
| SCN10A | sodium voltage-gated channel alpha subunit 10 | 3p22.2 | X |
| SCN11A | sodium voltage-gated channel alpha subunit 11 | 3p22.2 | X |

X: no expression detected

FIG. 7A

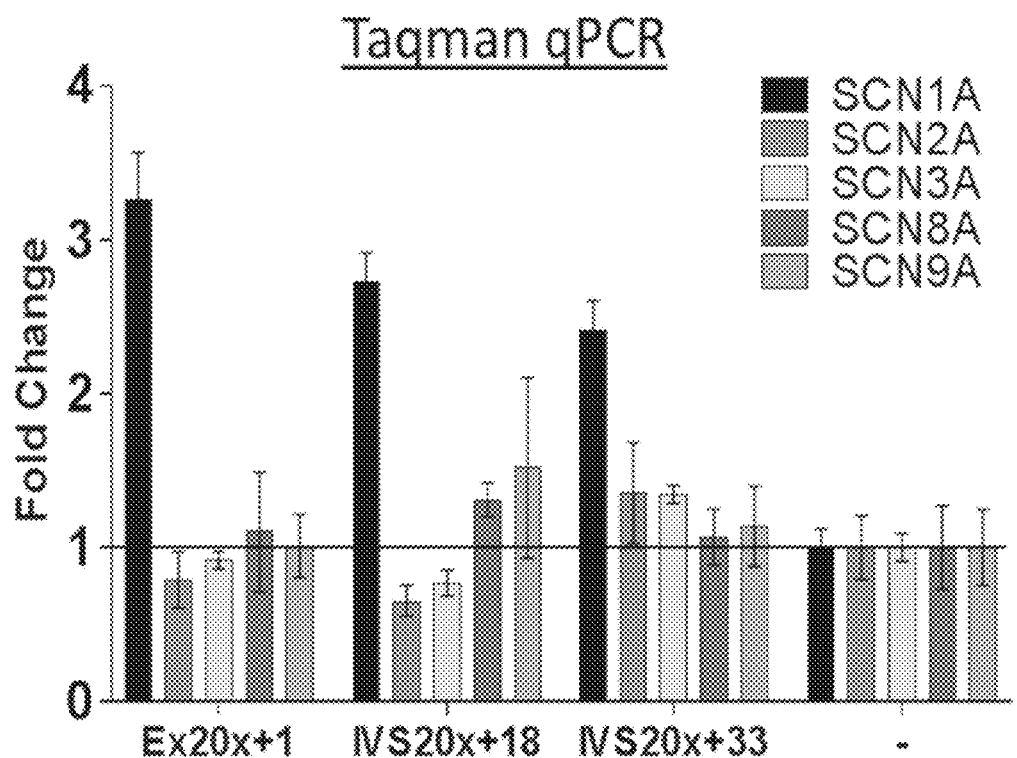

FIG. 7B

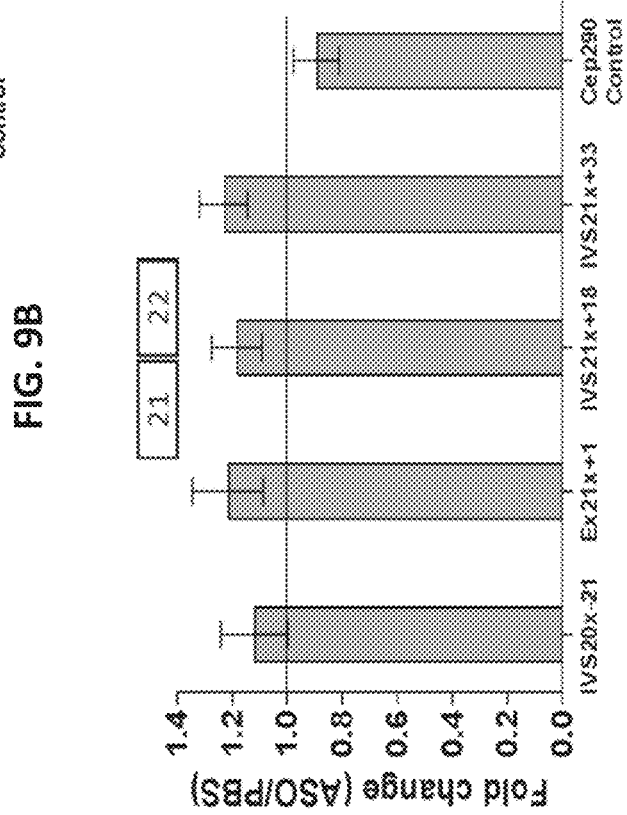
FIG. 9B
FIG. 9C
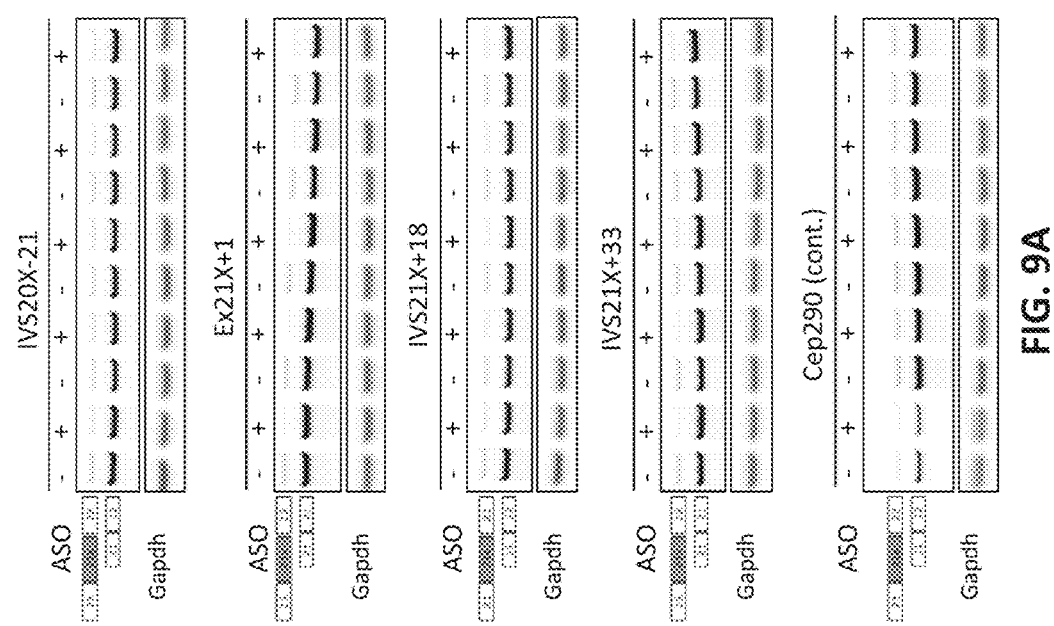
FIG. 9A

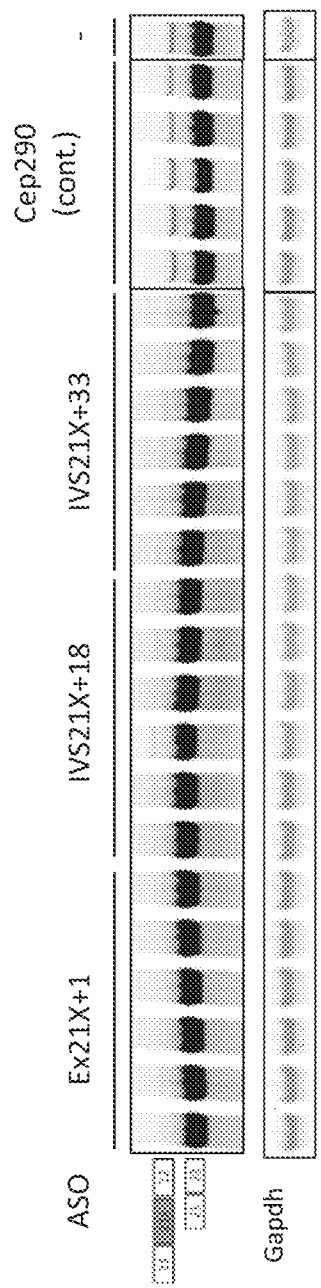
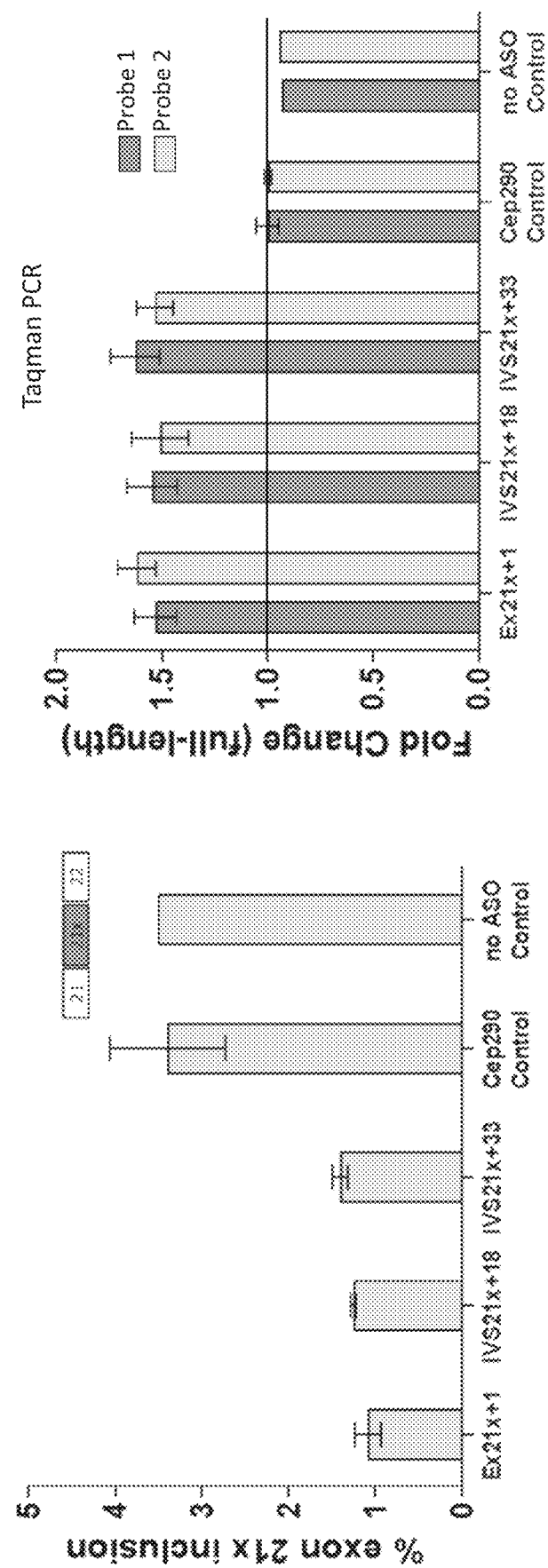
FIG. 10A
FIG. 10B
FIG. 10C

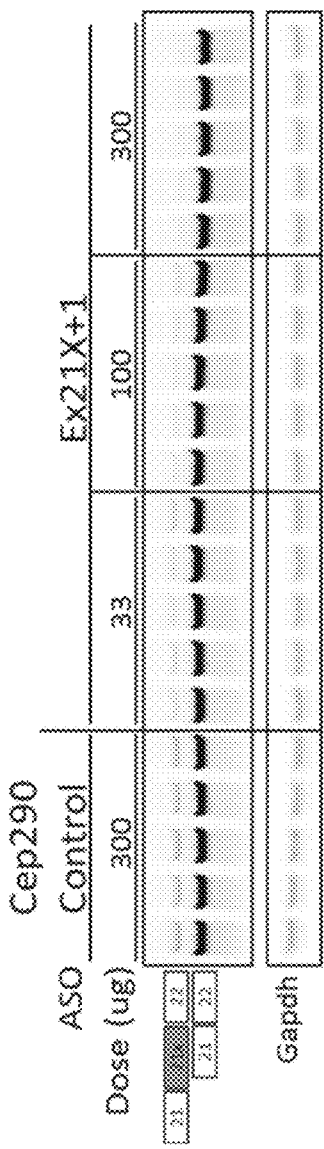
FIG. 11A
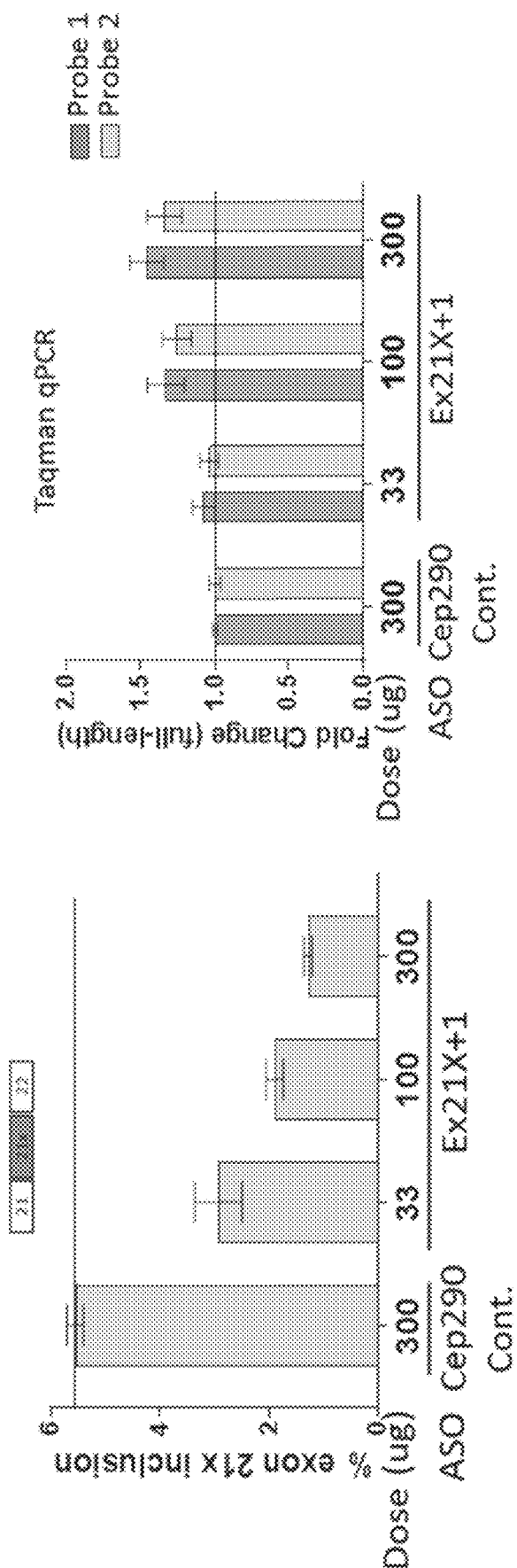
FIG. 11C
FIG. 11B

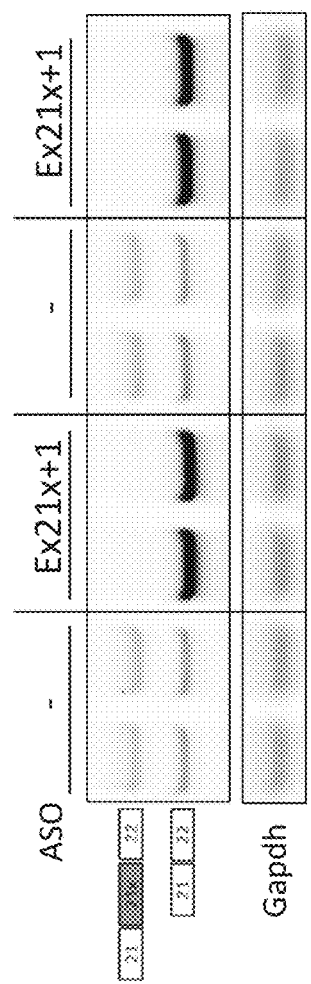
FIG. 12A
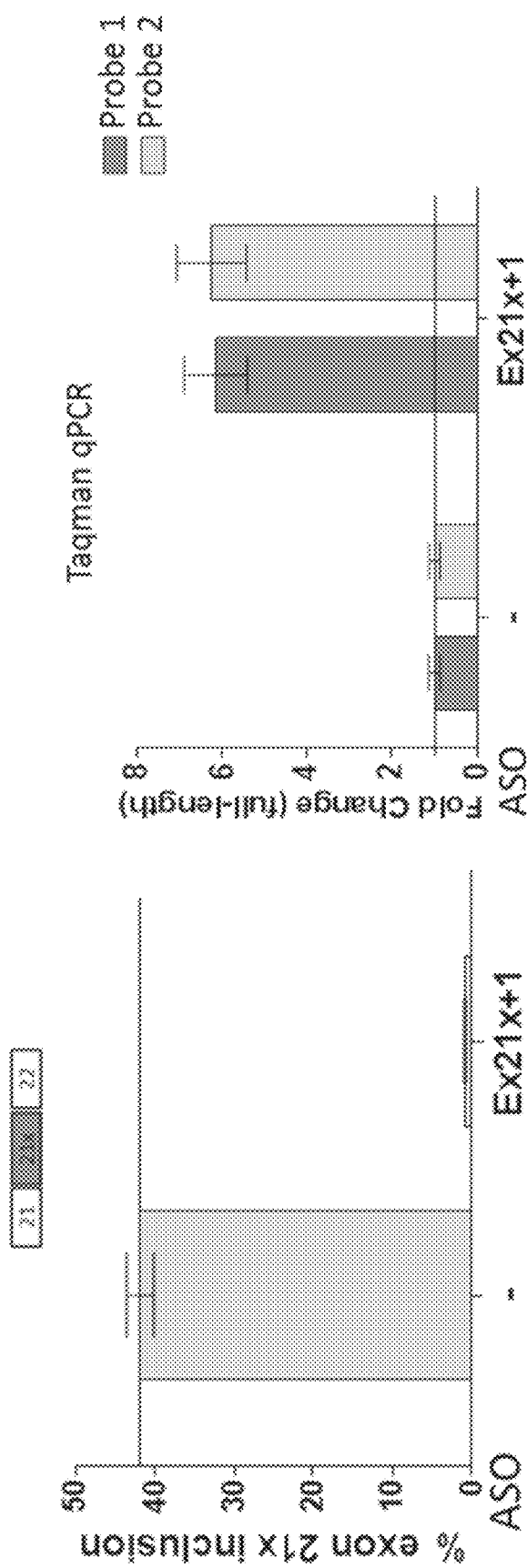
FIG. 12C
FIG. 12B

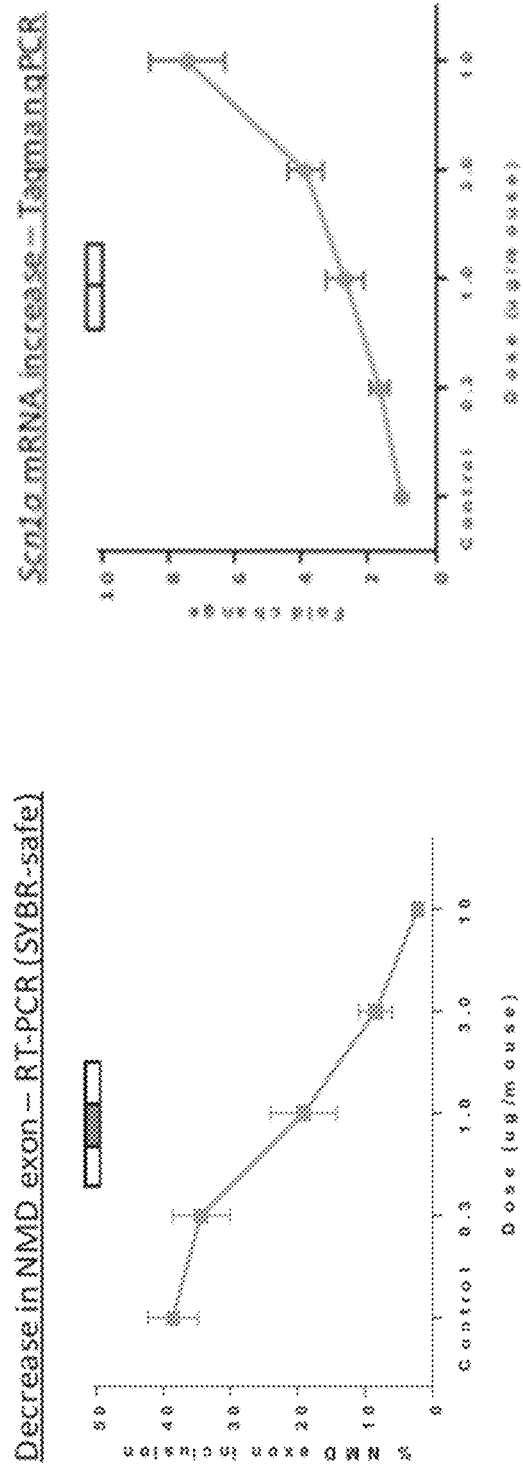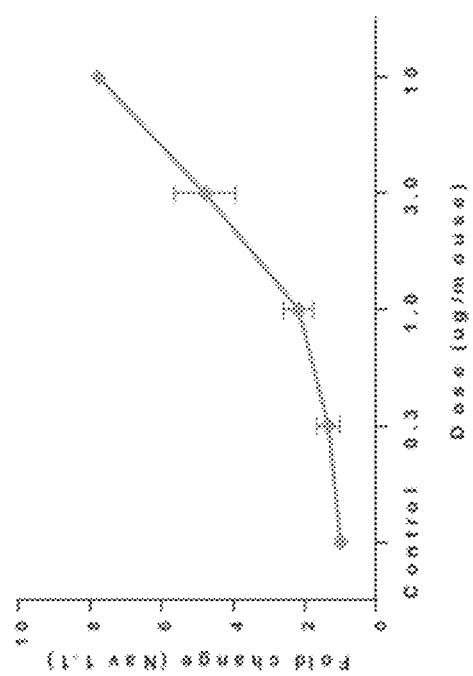
FIG. 14A FIG. 14B FIG. 14C

ANTISENSE OLIGOMERS FOR TREATMENT OF CONDITIONS AND DISEASES

CROSS-REFERENCE

This application is a continuation of international patent application no. PCT/US2018/48031 filed on Aug. 24, 2018 which claims the benefit of U.S. Provisional Application No. 62/550,462, filed on Aug. 25, 2017, U.S. Provisional Application No. 62/575,901, filed on Oct. 23, 2017, U.S. Provisional Application No. 62/667,356, filed on May 4, 2018, U.S. Provisional Application No. 62/671,745, filed on May 15, 2018, each of which is incorporated herein by reference in its entirety.

SEQUENCE LISTING

The instant application contains a Sequence Listing which has been submitted electronically in ASCII format and is hereby incorporated by reference in its entirety. Said ASCII copy, created on Jan. 6, 2020, is named 47991-719_601_SL.txt and is 998,937 bytes in size.

BACKGROUND OF THE INVENTION

Nervous system disorders are often associated with channelopathy, characterized by the disturbed function of ion channels that mediate neuronal excitability, neuronal interactions, and brain functions at large. Mutations in the SCN1A gene, which is part of the SCN1A-SCN2A-SCN3A gene cluster that encodes alpha-pore forming subunits of the neuronal voltage gated sodium channel, are associated with development of disease number of diseases and conditions, such as Dravet Syndrome (DS) (Miller, et al., 1993-2015, GeneReviews, Eds. Pagon R A, et al. Seattle (Wash.): University of Washington, Seattle, Bookshelf ID: NBK1318, and Mulley, et al., 2005, Hum. Mutat. 25: 535-542).

SUMMARY OF THE INVENTION

Disclosed herein, in certain embodiments, is a method of modulating expression of SCN1A protein in a cell having an mRNA that contains a non-sense mediated RNA decay-inducing exon (NMD exon mRNA) and encodes SCN1A protein, the method comprising contacting a therapeutic agent to the cell, whereby the therapeutic agent modulates splicing of the NMD exon from the NMD exon mRNA encoding SCN1A protein, thereby modulating the level of processed mRNA encoding SCN1A protein, and modulating expression of SCN1A protein in the cell. In some embodiments, the therapeutic agent (a) binds to a targeted portion of the NMD exon mRNA encoding SCN1A; (b) modulates binding of a factor involved in splicing of the NMD exon mRNA; or (c) a combination of (a) and (b). In some embodiments, the therapeutic agent interferes with binding of the factor involved in splicing of the NMD exon from a region of the targeted portion. In some embodiments, the targeted portion is proximal to the NMD exon. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of 5' end of the NMD exon. In some embodiments, the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides upstream of 5' end of the NMD exon. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of 3' end of the NMD exon. In some embodiments, the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides downstream of 3' end of the NMD exon. In some embodiments, the targeted portion is located in an intronic region between two canonical exonic regions of the NMD exon mRNA encoding SCN1A, and wherein the intronic region contains the NMD exon. In some embodiments, the targeted portion at least partially overlaps with the NMD exon. In some embodiments, the targeted portion at least partially overlaps with an intron upstream of the NMD exon. In some embodiments, the targeted portion comprises 5' NMD exon-intron junction or 3' NMD exon-intron junction. In some embodiments, the targeted portion is within the NMD exon. In some embodiments, the targeted portion comprises about 5, 6, 7, 8, 9, 10, 11, 12, 13, 14, 15, 16, 17, 18, 19, 20, 21, 22, 23, 24, 25, 26, 27, 28, 29, 30, or more consecutive nucleotides of the NMD exon. In some embodiments, the NMD exon mRNA encoding SCN1A comprises a sequence with at least about 80%, 85%, 90%, 95%, 97%, or 100% sequence identity to any one of SEQ ID NOs: 2 or 7-10. In some embodiments, the NMD exon mRNA encoding SCN1A is encoded by a genetic sequence with at least about 80%, 85%, 90%, 95%, 97%, or 100% sequence identity to SEQ ID NOs: 1 or 3-6. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of genomic site GRCh37/hg19: chr2:166,863,803. In some embodiments, the targeted portion is about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides upstream of genomic site GRCh37/hg19: chr2:166,863,803. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of genomic site GRCh37/hg19: chr2:166,863,740. In some embodiments, the targeted portion is about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides downstream of genomic site GRCh37/hg19: chr2:166,863,740. In some embodiments, the targeted portion of the NMD exon mRNA encoding SCN1A comprises a sequence with at least 80%, 85%, 90%, 95%, 97%, or 100% sequence identity to a region comprising at least 8 contiguous nucleic acids of SEQ ID NO: SEQ ID NOs: 2 or 7-10. In some embodiments, the therapeutic agent is an antisense oligomer (ASO) and wherein the ASO comprises a sequence that is at least about 80%, 85%, 90%, 95%, 97%, or 100% identity to any one of SEQ ID NOs: 21-67, 210-256, or 304-379. In some embodiments, the targeted portion of the NMD exon mRNA encoding SCN1A is within the non-sense mediated RNA decay-inducing exon 20x of SCN1A. In some embodiments, the therapeutic agent is an antisense oligomer (ASO) and wherein the ASO comprises a sequence that is at least about 80%, 85%, 90%, 95%, 97%, or 100% identity to any one of SEQ ID NOs: 42-50, or 231-239. In some embodiments, the targeted portion of the NMD exon mRNA encoding SCN1A is upstream or downstream of the non-sense mediated RNA decay-inducing exon 20x of SCN1A. In some embodiments, the therapeutic agent is an antisense oligomer (ASO) and wherein the ASO comprises a sequence that is at least about 80%, 85%, 90%, 95%, 97%, or 100% identity to any one of SEQ ID NOs: 21-38, 53-67, 210-227, or 242-256. In some embodiments, the targeted portion of the NMD exon mRNA comprises an exon-intron junction of exon 20x of SCN1A. In some embodiments, the therapeutic agent is an antisense oligomer (ASO) and wherein the ASO comprises a sequence that is at least about 80%, 85%, 90%, 95%, 97%, or 100% identity to any one of SEQ ID NOs: 39-41, 51, 52, 228-230, 240, or 241. In some embodiments, the therapeutic agent promotes exclusion of the NMD exon from the processed mRNA encoding SCN1A protein. In some embodiments, exclusion of the NMD exon from the processed mRNA encoding SCN1A protein in the cell contacted with the therapeutic agent is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding SCN1A protein in a control cell. In some embodiments, the therapeutic agent increases level of the processed mRNA encoding SCN1A protein in the cell.

In some embodiments, an amount of the processed mRNA encoding SCN1A protein in the cell contacted with the therapeutic agent is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of the processed mRNA encoding SCN1A protein in a control cell. In some embodiments, the therapeutic agent increases expression of SCN1A protein in the cell. In some embodiments, an amount of SCN1A produced in the cell contacted with the therapeutic agent is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of SCN1A produced in a control cell. In some embodiments, the therapeutic agent inhibits exclusion of the NMD exon from the processed mRNA encoding SCN1A protein. In some embodiments, exclusion of the NMD exon from the processed mRNA encoding SCN1A protein in the cell contacted with the therapeutic agent is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding SCN1A protein in a control cell. In some embodiments, the therapeutic agent decreases level of the processed mRNA encoding SCN1A protein in the cell. In some embodiments, an amount of the processed mRNA encoding SCN1A protein in the cell contacted with the therapeutic agent is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of the processed mRNA encoding SCN1A protein in a control cell. In some embodiments, the therapeutic agent decreases expression of SCN1A protein in the cell. In some embodiments, an amount of SCN1A produced in the cell contacted with the therapeutic agent is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of SCN1A produced in a control cell. In some embodiments, the therapeutic agent is an antisense oligomer (ASO) and wherein the antisense oligomer comprises a backbone modification comprising a phosphorothioate linkage or a phosphorodiamidate linkage. In some embodiments, the therapeutic agent is an antisense oligomer (ASO) and wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the therapeutic agent is an antisense oligomer (ASO) and wherein the antisense oligomer comprises at least one modified sugar moiety. In some embodiments, each sugar moiety is a modified sugar moiety. In some embodiments, the therapeutic agent is an antisense oligomer (ASO) and wherein the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the therapeutic agent is an antisense oligomer (ASO) and wherein the antisense oligomer is at least 80%, at least 85%, at least 90%, at least 95%, at least 98%, at least 99%, or 100%, complementary to the targeted portion of the NMD exon mRNA encoding the protein. In some embodiments, the method further comprises assessing SCN1A mRNA or protein expression. In some embodiments, the cells are ex vivo.

Disclosed herein, in certain embodiments, is a method of treating a disease or condition in a subject in need thereof by modulating expression of SCN1A protein in a cell of the subject, comprising: contacting the cell of the subject with a therapeutic agent that modulates splicing of a non-sense mediated mRNA decay-inducing exon (NMD exon) from an mRNA in the cell that contains the NMD exon and encodes SCN1A, thereby modulating the level of processed mRNA encoding the SCN1A protein, and modulating expression of SCN1A protein in the cell of the subject. In some embodiments, the therapeutic agent (a) binds to a targeted portion of the NMD exon mRNA encoding SCN1A; (b) modulates binding of a factor involved in splicing of the NMD exon mRNA; or (c) a combination of (a) and (b). In some embodiments, the therapeutic agent interferes with binding of the factor involved in splicing of the NMD exon from a region of the targeted portion. In some embodiments, the targeted portion is proximal to the NMD exon. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of 5' end of the NMD exon. In some embodiments, the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides upstream of 5' end of the NMD exon. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of 3' end of the NMD exon. In some embodiments, the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides downstream of 3' end of the NMD exon. In some embodiments, the targeted portion is located in an intronic region between two canonical exonic regions of the NMD exon mRNA encoding SCN1A, and wherein the intronic region contains the NMD exon. In some embodiments, the targeted portion at least partially overlaps with the NMD exon. In some embodiments, the targeted portion at least partially overlaps with an intron upstream of the NMD exon. In some embodiments, the targeted portion comprises 5' NMD exon-intron junction or 3' NMD exon-intron junction. In some embodiments, the targeted portion is within the NMD exon. In some embodiments, the targeted portion comprises about 5, 6, 7, 8, 9, 10, 11, 12, 13, 14, 15, 16, 17, 18, 19, 20, 21, 22, 23, 24, 25, 26, 27, 28, 29, 30, or more consecutive nucleotides of the NMD exon. In some embodiments, the NMD exon mRNA encoding SCN1A comprises a sequence with at least about 80%, 85%, 90%, 95%, 97%, or 100% sequence identity to any one of SEQ ID NOs: 2 or 7-10. In some embodiments, the NMD exon mRNA encoding SCN1A is encoded by a genetic sequence with at least about 80%, 85%, 90%, 95%, 97%, or 100% sequence identity to SEQ ID NOs: 1 or 3-6. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of genomic site GRCh37/hg19: chr2:166,863,803. In some embodiments, the targeted portion is about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides upstream of genomic site GRCh37/hg19: chr2:166,863,803. In some embodiments, the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of genomic site GRCh37/hg19: chr2:166,863,740. In some embodiments, the targeted portion is about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides downstream of genomic site GRCh37/hg19: chr2:166,863,740. In some embodiments, the targeted portion of the NMD exon mRNA encoding SCN1A comprises a sequence with at least 80%, 85%, 90%, 95%, 97%, or 100% sequence identity to a region comprising at least 8 contiguous nucleic acids of SEQ ID NO: SEQ ID NOs: 2 or 7-10. In some embodiments, the therapeutic agent is an antisense oligomer (ASO) and wherein the ASO comprises a sequence that is at least about 80%, 85%, 90%, 95%, 97%, or 100% identity to any one of SEQ ID NOs: 21-67, 210-256, or 304-379. In some embodiments, the targeted portion of the NMD exon mRNA encoding SCN1A is within the non-sense mediated RNA decay-inducing exon 20x of SCN1A. In some embodiments, the therapeutic agent is an antisense oligomer (ASO) and wherein the ASO comprises a sequence that is at least about 80%, 85%, 90%, 95%, 97%, or 100% identity to any one of SEQ ID NOs: 42-50, or 231-239. In some embodiments, the targeted portion of the NMD exon mRNA encoding SCN1A is upstream or downstream of the non-sense mediated RNA decay-inducing exon 20x of SCN1A. In some embodiments, the therapeutic agent is an antisense oligomer (ASO) and wherein the ASO comprises a sequence that is at least about 80%, 85%, 90%, 95%, 97%, or 100% identity to any one of SEQ ID NOs: 21-38, 53-67, 210-227, or 242-256. In some embodiments, the targeted portion of the NMD exon mRNA comprises an exon-intron junction of exon 20x of SCN1A. In some embodiments, the therapeutic agent is an antisense oligomer (ASO) and wherein the ASO comprises a sequence that is at least about 80%, 85%, 90%, 95%, 97%, or 100% identity to any one of SEQ ID NOs: 39-41, 51, 52, 228-230, 240, or 241. In some embodiments, the therapeutic agent promotes exclusion of the NMD exon from the processed mRNA encoding SCN1A protein. In some embodiments, exclusion of the NMD exon from the processed mRNA encoding SCN1A protein in the cell contacted with the therapeutic agent is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding SCN1A protein in a control cell. In some embodiments, the therapeutic agent increases level of the processed mRNA encoding SCN1A protein in the cell. In some embodiments, an amount of the processed mRNA encoding SCN1A protein in the cell contacted with the therapeutic agent is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of the processed mRNA encoding SCN1A protein in a control cell. In some embodiments, the therapeutic agent increases expression of SCN1A protein in the cell. In some embodiments, an amount of SCN1A produced in the cell contacted with the therapeutic agent is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of SCN1A produced in a control cell. In some embodiments, the therapeutic agent inhibits exclusion of the NMD exon from the processed mRNA encoding SCN1A protein. In some embodiments, exclusion of the NMD exon from the processed mRNA encoding SCN1A protein in the cell contacted with the therapeutic agent is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding SCN1A protein in a control cell. In some embodiments, the therapeutic agent decreases level of the processed mRNA encoding SCN1A protein in the cell. In some embodiments, an amount of the processed mRNA encoding SCN1A protein in the cell contacted with the therapeutic agent is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of the processed mRNA encoding SCN1A protein in a control cell. In some embodiments, the therapeutic agent decreases expression of SCN1A protein in the cell. In some embodiments, an amount of SCN1A produced in the cell contacted with the therapeutic agent is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of SCN1A produced in a control cell. In some embodiments, the therapeutic agent is an antisense oligomer (ASO) and wherein the antisense oligomer comprises a backbone modification comprising a phosphorothioate linkage or a phosphorodiamidate linkage. In some embodiments, the therapeutic agent is an antisense oligomer (ASO) and wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety. In some embodiments, the therapeutic agent is an antisense oligomer (ASO) and wherein the antisense oligomer comprises at least one modified sugar moiety. In some embodiments, each sugar moiety is a modified sugar moiety. In some embodiments, the therapeutic agent is an antisense oligomer (ASO) and wherein the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases. In some embodiments, the therapeutic agent is an antisense oligomer (ASO) and wherein the antisense oligomer is at least 80%, at least 85%, at least 90%, at least 95%, at least 98%, at least 99%, or 100%, complementary to the targeted portion of the NMD exon mRNA encoding the protein. In some embodiments, the method further comprises assessing SCN1A mRNA or protein expression. In some embodiments, the disease or condition is induced by a loss-of-function mutation in $Na_v1.1$. In some embodiments, the disease or condition is associated with haploinsufficiency of the SCN1A gene, and wherein the subject has a first allele encoding a functional SCN1A, and a second allele from which SCN1A is not produced or produced at a reduced level, or a second allele encoding a nonfunctional SCN1A or a partially functional SCN1A. In some embodiments, the disease or condition is encephalopathy. In some embodiments, the encephalopathy is epileptic encephalopathy. In some embodiments, the disease or condition is Dravet Syndrome (DS); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); sick sinus syndrome 1; autism; or malignant migrating partial seizures of infancy. In some embodiments, GEFS+ is epilepsy, generalized, with febrile seizures plus, type 2. In some embodiments, the Febrile seizure is Febrile seizures, familial, 3A. In some embodiments, SMEB is SMEB without generalized spike wave (SMEB-SW), SMEB without myoclonic seizures (SMEB-M), SMEB lacking more than one feature of SMEI (SMEB-O), or intractable childhood epilepsy with generalized tonic-clonic seizures (ICEGTC). In some embodiments, the therapeutic agent promotes exclusion of the NMD exon from the processed mRNA encoding SCN1A protein and increases the expression of SCN1A in the cell. In some embodiments, the therapeutic agent is an antisense oligomer (ASO) and wherein the ASO comprises a sequence that is at least about 80%, 85%, 90%, 95%, 97%, or 100% complimentary to any one of SEQ ID NOs: 22-24, 26, 27, 29-35, 37-62, 64-67, or 304-379. In some embodiments, the disease or condition is induced by a gain-of-function mutation in $Na_v1.1$. In some embodiments, the subject has an allele from which SCN1A is produced at an increased level, or an allele encoding a mutant SCN1A that induces increased activity of $Na_v1.1$ in the cell. In some embodiments, the disease or condition is migraine. In some embodiments, the migraine is migraine, familial hemiplegic, 3. In some embodiments, the disease or condition is a $Na_v1.1$ genetic epilepsy. In some embodiments, the therapeutic agent inhibits exclusion of the NMD exon from the processed mRNA encoding SCN1A protein and decreases the expression of SCN1A in the cell. In some embodiments, the therapeutic agent is an antisense oligomer (ASO) and wherein the ASO comprises a sequence that is at least about 80%, 85%, 90%, 95%, 97%, or 100% complimentary to any one of SEQ ID NOs: 21, 25, 28, 36, or 63. In some embodiments, the subject is a human. In some embodiments, the subject is a non-human animal. In some embodiments, the subject is a fetus, an embryo, or a child. In some embodiments, the therapeutic agent is administered by intrathecal injection, intracerebroventricular injection, intraperitoneal injection, intramuscular injection, subcutaneous injection, intravitreal, or intravenous injection of the subject. In some embodiments, the method further comprises administering a second therapeutic agent to the subject. In some embodiments, the second therapeutic agent is a small molecule. In some embodiments, the second therapeutic agent is an ASO. In some embodiments, the ASO comprises a sequence that is at least about 80%, 85%, 90%, 95%, 97%, or 100% complementary to any one of SEQ ID NOs: 115-161. In some embodiments, the second therapeutic agent corrects intron retention. In some embodiments, the disease or condition is Alzheimer's Disease, SCN2A encephalopathy, SCN8A encephalopathy, or SCN5A arrhythmia. In some embodiments, the disease or condition is Alzheimer's Disease, SCN2A encephalopathy, SCN8A encephalopathy, or SCN5A arrythmia. In some embodiments, the cells are ex vivo.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

FIG. 1A shows a cell divided into nuclear and cytoplasmic compartments. In the nucleus, a pre-mRNA transcript of a target gene undergoes splicing to generate mRNA, and this mRNA is exported to the cytoplasm and translated into target protein. For this target gene, some fraction of the mRNA contains a nonsense-mediated mRNA decay-inducing exon (NMD exon mRNA) that is degraded in the cytoplasm, thus leading to no target protein production. FIG. 1B shows an example of the same cell divided into nuclear and cytoplasmic compartments. Treatment with a therapeutic agent, such as an antisense oligomer (ASO), promotes the exclusion of the nonsense-mediated mRNA decay-inducing exon and results in an increase in mRNA, which is in turn translated into higher levels of target protein. FIG. 1C is a schematic representation of therapeutic ASO-mediated exclusion of a nonsense-mediated mRNA decay-inducing exon, which turns a non-productive mRNA into a productive mRNA and increases expression of the full-length target protein from the productive mRNA.

FIG. 4 depicts an exemplary SCN1A exon 20x region ASO walk. A graphic representation of an ASO walk performed for SCN1A exon 20x region targeting sequences upstream of the 3' splice site, across the 3'splice site, exon 20x, across the 5' splice site, and downstream of the 5' splice site using 2'-MOE ASOs, PS backbone, is shown. ASOs were designed to cover these regions by shifting 5 nucleotides at a time.

FIG. 7A depicts a table with members of the sodium voltage-gaited channel alpha subunit members. Arrows correspond to bar colors in FIG. 7B. X denotes no expression detected.

FIG. 7B depicts selected ASOs evaluated by Taqman qPCR of SCN1A, SCN2A, SCN3A, SCN8A, and SCN9A to assess target selectivity. Taqman-qPCR amplification results normalized to RPL32, obtained using Ex20x+1, IVS20x+18, and IVS20x+33 ASOs, are plotted as fold change relative to Sham. The black line indicates a ratio of 1 (no change with respect to sham).

FIG. 9A depicts exemplary results from intravitreal (IVT) injection of selected ASOs in C57BL6J mice (male, 3 months old). PAGE gels of SYBR-safe-stained RT-PCR products of mouse Scn1a from PBS-injected (1 µL) left eye (−) or IVS20x-21, Ex21x+1, IVS21x+18, IVS21x+33 or Cep290 (negative control ASO; Gerard et al, *Mol. Ther. Nuc. Ac.*, 2015) 2'-MOE ASO-injected (1 µL) right eye (+) at 10 mM concentration are shown. Ex21x+1, IVS21x+18, and IVS21x+33 (mouse nomenclature) and Ex20x+1, IVS20x+18, and IVS20x+33 (human nomenclature) are identical. Two products corresponding to exon 21x inclusion (top band) and full-length (exon 21x exclusion, bottom band) were quantified.

FIG. 9B depicts a graph plotting the percent exon 21x inclusion from the data in FIG. 9A. White bars correspond to ASO-injected eyes and grey bars correspond to PBS-injected eyes, n=5 in each group.

FIG. 9C depicts a graph of the full-length products were normalized to Gapdh internal control and fold-change of ASO-injected eye relative to PBS-injected eye is plotted. The black line indicates a ratio of 1 and no change with respect to PBS, n=5 in each group.

FIG. 10A depicts exemplary results from intracerebroventricular (ICV) injection of selected ASOs in C57BL6J mice (male, 3 months old). PAGE gels of SYBR-safe-stained RT-PCR products of mouse Scn1a from uninjected (-, no ASO control), or 300 µg of Cep290 (negative control ASO; Gerard et al, *Mol. Ther. Nuc. Ac.*, 2015), Ex21x+1, IVS21x+18, IVS21x+33 2'-MOE ASO-injected brains are shown. Ex21x+1, IVS21x+18, and IVS21x+33 (mouse nomenclature) and Ex20x+1, IVS20x+18, and IVS20x+33 (human nomenclature) are identical. Two products corresponding to exon 21x inclusion (top band) and full-length (exon 21x exclusion, bottom band) were quantified.

FIG. 10B depicts a graph plotting the percent exon 21x inclusion from the data in FIG. 10A, n=6 (each targeting ASO), n=5 (Cep290 ASO), n=1 (uninjected, no ASO control).

FIG. 10C depicts a graph from results of a Taqman qPCR assay performed using two different probes spanning exons 21 and 22 junction. The products were normalized to Gapdh internal control and fold-change of ASO-injected relative to Cep290-injected brains is plotted. The black line indicates a ratio of 1 and no change with respect to Cep290, n=6 (each targeting ASO), n=5 (Cep290 ASO), n=1 (uninjected, no ASO control).

FIG. 11A depicts exemplary results from intracerebroventricular (ICV) injection of selected ASOs in C57BL6J mice (male, 3 months old). PAGE gels of SYBR-safe-stained RT-PCR products of mouse Scn1a from 300 ug of Cep290 (negative control ASO; Gerard et al, *Mol. Ther. Nuc. Ac.*, 2015), or 33 ug, 100 ug, and 300 ug of Ex21x+1 2'-MOE ASO-injected brains. Ex21x+1 (mouse nomenclature) and Ex20x+1, (human nomenclature) are identical. Two products corresponding to exon 21x inclusion (top band) and full-length (exon 21x exclusion, bottom band) were quantified.

FIG. 11B depicts a graph plotting the percent exon 21x inclusion from the data in FIG. 11A, n=5 (each group).

FIG. 11C depicts a graph from results of a Taqman qPCR assay performed using two different probes spanning exons 21 and 22 junction. The products were normalized to Gapdh internal control and fold-change of ASO-injected relative to Cep290-injected brains is plotted. The black line indicates a ratio of 1 and no change with respect to Cep290, n=5 (each group).

FIG. 12A depicts exemplary results from intracerebroventricular (ICV) injection of a selected ASO in C57BL6J mice (postnatal day 2). PAGE gels of SYBR-safe-stained RT-PCR products of mouse Scn1a from uninjected (-, no ASO control), or 20 µg Ex21x+1 2'-MOE ASO-injected brains are shown. Two products corresponding to exon 21x inclusion (top band) and full-length (exon 21x exclusion, bottom band) were quantified. Ex21x+1 (mouse nomenclature) and Ex20x+1 (human nomenclature) are identical.

FIG. 12B depicts a graph plotting the percent exon 21x inclusion from the data in FIG. 12A, n=4 (each group).

FIG. 12C depicts a graph from results of a Taqman qPCR assay performed using two different probes spanning exons 21 and 22 junction. The products were normalized to Gapdh internal control and fold-change of ASO-injected relative to no-ASO-control brains is plotted. The black line indicates a ratio of 1 and no change with respect to no-ASO control, n=4 (each group).

FIG. 14A depicts a graph plotting the percent decrease in exon 21x inclusion at the indicated doses.

FIG. 14B depicts a graph plotting the percent increase in Scn1a mRNA at the indicated doses.

FIG. 14C depicts a graph plotting the percent increase in Nav 1.1 protein levels at the indicated doses.

FIG. 17A depicts a graph from results of a Taqman qPCR assay performed using a probe spanning exons 21 and 22. The products were normalized to Gapdh internal control and fold-change of ASO-injected relative to PBS-injected brains is plotted.

FIG. 17B depicts a graph from results of a western blot performed using an anti-Nav1.1 antibody. The products were normalized to Ponceau-stained bands and fold-change of ASO-injected relative to PBS-injected brains is plotted.

DETAILED DESCRIPTION OF THE INVENTION

Splicing and Nonsense-Mediated mRNA Decay

Figure 1A:
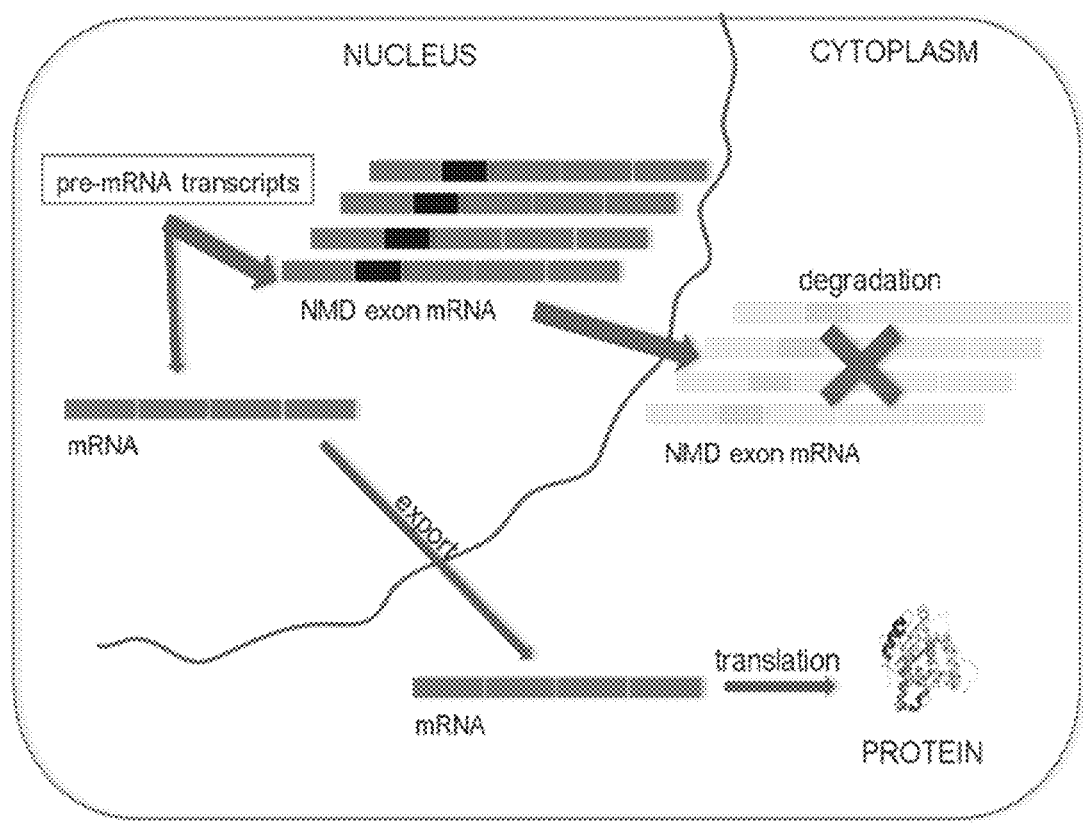
FIGS. 1A-C depict a schematic representation of a target mRNA that contains a non-sense mediated RNA decay-inducing exon (NMD exon mRNA) and therapeutic agent-mediated exclusion of the nonsense-mediated mRNA decay-inducing exon to increase expression of the full-length target protein or functional RNA.
Figure 1B:
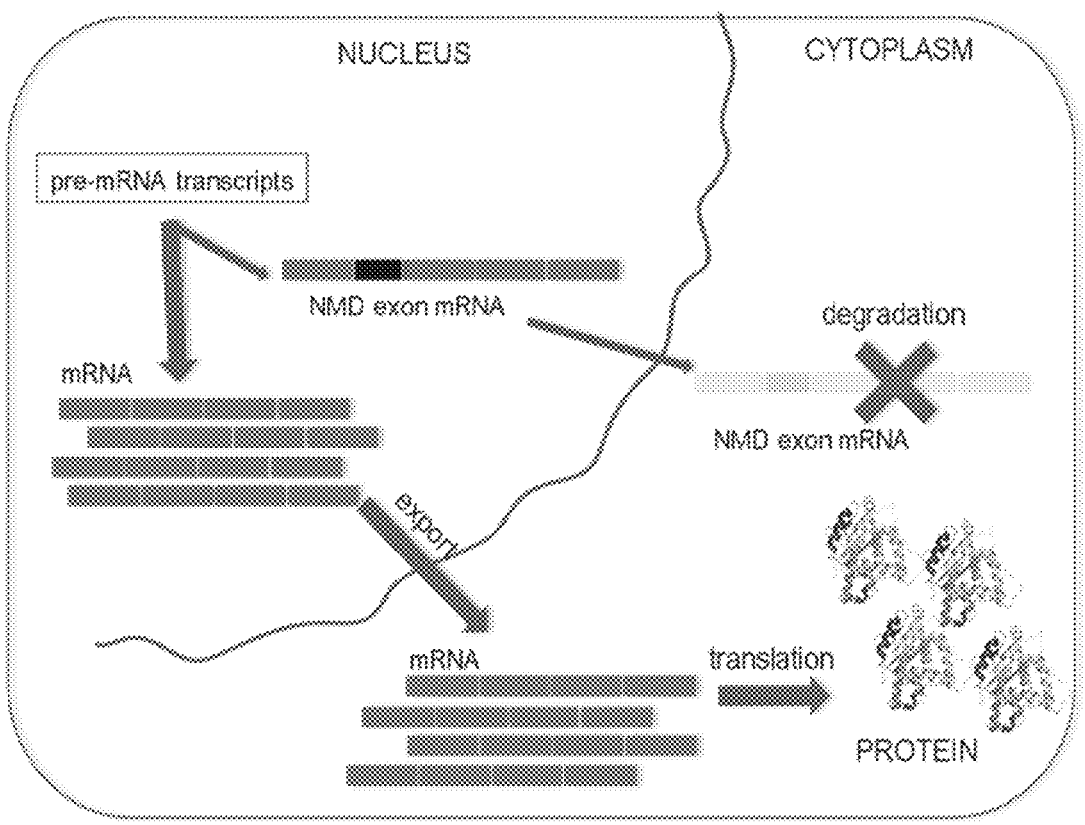
Figure 1C:
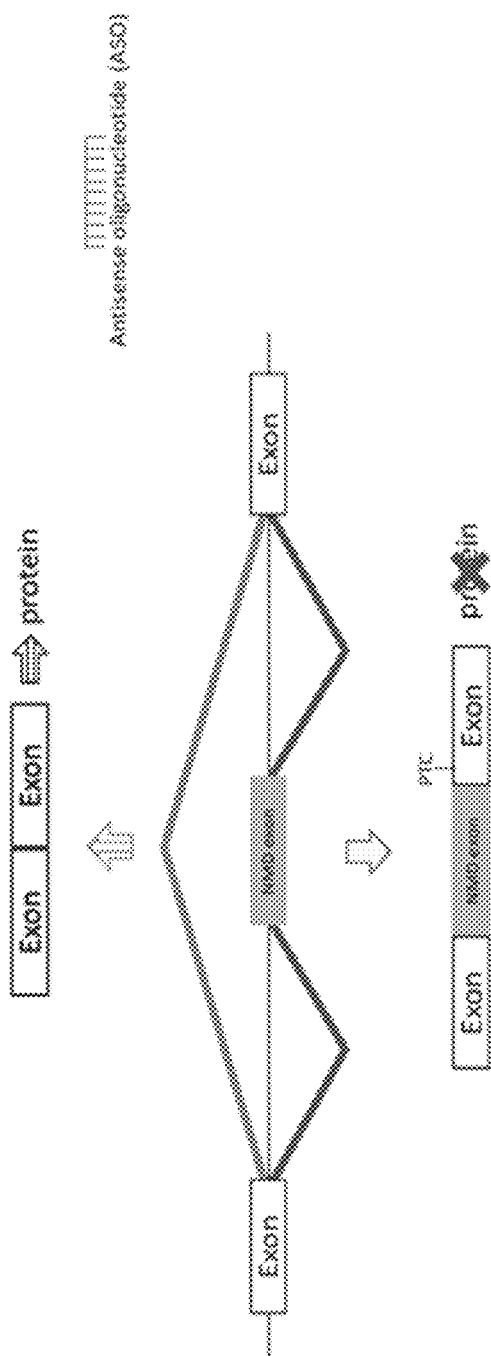

Intervening sequences or introns are removed by a large and highly dynamic RNA-protein complex termed the spliceosome, which orchestrates complex interactions between primary transcripts, small nuclear RNAs (snRNAs) and a large number of proteins. Spliceosomes assemble ad hoc on each intron in an ordered manner, starting with recognition of the 5' splice site (5'ss) by U1 snRNA or the 3'splice site (3'ss) by the U2 pathway, which involves binding of the U2 auxiliary factor (U2AF) to the 3'ss region to facilitate U2 binding to the branch point sequence (BPS). U2AF is a stable heterodimer composed of a U2AF2-encoded 65-kD subunit (U2AF65), which binds the polypyrimidine tract (PPT), and a U2AF1-encoded 35-kD subunit (U2AF35), which interacts with highly conserved AG dinucleotides at 3'ss and stabilizes U2AF65 binding. In addition to the BPS/PPT unit and 3'ss/5'ss, accurate splicing requires auxiliary sequences or structures that activate or repress splice site recognition, known as intronic or exonic splicing enhancers or silencers. These elements allow genuine splice sites to be recognized among a vast excess of cryptic or pseudo-sites in the genome of higher eukaryotes, which have the same sequences but outnumber authentic sites by an order of magnitude. Although they often have a regulatory function, the exact mechanisms of their activation or repression are poorly understood.

The decision of whether to splice or not to splice can be typically modeled as a stochastic rather than deterministic process, such that even the most defined splicing signals can sometimes splice incorrectly. However, under normal conditions, pre-mRNA splicing proceeds at surprisingly high fidelity. This is attributed in part to the activity of adjacent cis-acting auxiliary exonic and intronic splicing regulatory elements (ESRs or ISRs). Typically, these functional elements are classified as either exonic or intronic splicing enhancers (ESEs or ISEs) or silencers (ESSs or ISSs) based on their ability to stimulate or inhibit splicing, respectively. Although there is now evidence that some auxiliary cis-acting elements may act by influencing the kinetics of spliceosome assembly, such as the arrangement of the complex between U1 snRNP and the 5'ss, it seems very likely that many elements function in concert with trans-acting RNA-binding proteins (RBPs). For example, the serine- and arginine-rich family of RBPs (SR proteins) is a conserved family of proteins that have a key role in defining exons. SR proteins promote exon recognition by recruiting components of the pre-spliceosome to adjacent splice sites or by antagonizing the effects of ESSs in the vicinity. The repressive effects of ESSs can be mediated by members of the heterogeneous nuclear ribonucleoprotein (hnRNP) family and can alter recruitment of core splicing factors to adjacent splice sites. In addition to their roles in splicing regulation, silencer elements are suggested to have a role in repression of pseudo-exons, sets of decoy intronic splice sites with the typical spacing of an exon but without a functional open reading frame. ESEs and ESSs, in cooperation with their cognate trans-acting RBPs, represent important components in a set of splicing controls that specify how, where and when mRNAs are assembled from their precursors.

The sequences marking the exon-intron boundaries are degenerate signals of varying strengths that can occur at high frequency within human genes. In multi-exon genes, different pairs of splice sites can be linked together in many different combinations, creating a diverse array of transcripts from a single gene. This is commonly referred to as alternative pre-mRNA splicing. Although most mRNA isoforms produced by alternative splicing can be exported from the nucleus and translated into functional polypeptides, different mRNA isoforms from a single gene can vary greatly in their translation efficiency. Those mRNA isoforms with premature termination codons (PTCs) at least 50 bp upstream of an exon junction complex are likely to be targeted for degradation by the nonsense-mediated mRNA decay (NMD) pathway. Mutations in traditional (BPS/PPT/3'ss/5'ss) and auxiliary splicing motifs can cause aberrant splicing, such as exon skipping or cryptic (or pseudo-) exon inclusion or splice-site activation, and contribute significantly to human morbidity and mortality. Both aberrant and alternative splicing patterns can be influenced by natural DNA variants in exons and introns.

Given that exon-intron boundaries can occur at any of the three positions of a codon, it is clear that only a subset of alternative splicing events can maintain the canonical open reading frame. For example, only exons that are evenly divisible by 3 can be skipped or included in the mRNA without any alteration of reading frame. Splicing events that do not have compatible phases will induce a frame-shift. Unless reversed by downstream events, frame-shifts can certainly lead to one or more PTCs, probably resulting in subsequent degradation by NMD. NMD is a translation-coupled mechanism that eliminates mRNAs containing PTCs. NMD can function as a surveillance pathway that exists in all eukaryotes. NMD can reduce errors in gene expression by eliminating mRNA transcripts that contain premature stop codons. Translation of these aberrant mRNAs could, in some cases, lead to deleterious gain-of-function or dominant-negative activity of the resulting proteins. NMD targets not only transcripts with PTCs but also a broad array of mRNA isoforms expressed from many endogenous genes, suggesting that NMD is a master regulator that drives both fine and coarse adjustments in steady-state RNA levels in the cell.

A NMD-inducing exon (NIE) is an exon or a pseudo-exon that is a region within an intron and can activate the NMD pathway if included in a mature RNA transcript. In the constitutive splicing events, the intron containing an NIE is usually spliced out, but the intron or a portion thereof (e.g. NIE) can be retained during alternative or aberrant splicing events. Mature mRNA transcripts containing such an NIE can be non-productive due to frame shift which induce NMD pathway. Inclusion of a NIE in mature RNA transcripts can downregulate gene expression. mRNA transcripts containing an NIE can be referred as "NIE containing mRNA" or "NMD exon mRNA" in the current disclosure.

Cryptic (or pseudo-splice sites) have the same splicing recognition sequences as genuine splice sites but are not used in the splicing reactions. They outnumber genuine splice sites in the human genome by an order of a magnitude and are normally repressed by thus far poorly understood molecular mechanisms. Cryptic 5' splice sites have the consensus NNN/GUNNNN or NNN/GCNNNN where N is any nucleotide and/is the exon-intron boundary. Cryptic 3' splice sites have the consensus NAG/N. Their activation is positively influenced by surrounding nucleotides that make them more similar to the optimal consensus of authentic splice sites, namely MAG/GURAGU and YAG/G, respectively, where M is C or A, R is G or A, and Y is C or U.

Splice sites and their regulatory sequences can be readily identified by a skilled person using suitable algorithms publicly available, listed for example in Kralovicova, J. and Vorechovsky, I. (2007) Global control of aberrant splice site activation by auxiliary splicing sequences: evidence for a gradient in exon and intron definition. *Nucleic Acids Res.*, 35, 6399-6413, (http://www.ncbi.nlm.nih.gov/pmc/articles/PMC2095810/pdf/gkm680.pdf)

The cryptic splice sites or splicing regulatory sequences may compete for RNA-binding proteins such as U2AF with a splice site of the NIE. In one embodiment, an agent may bind to the cryptic splice site or splicing regulatory sequences to prevent the binding of RNA-binding proteins and thereby favoring utilization of the NIE splice sites.

In one embodiment, the cryptic splice site may not comprise the 5' or 3' splice site of the NIE. The cryptic splice site may be at least 10 nucleotides upstream of the NIE 5' splice site. The cryptic splice site may be at least 20 nucleotides upstream of the NIE 5' splice site. The cryptic splice site may be at least 50 nucleotides upstream of the NIE 5' splice site. The cryptic splice site may be at least 100 nucleotides upstream of the NIE 5' splice site. The cryptic splice site may be at least 200 nucleotides upstream of the NIE 5' splice site.

The cryptic splice site may be at least 10 nucleotides downstream of the NIE 3' splice site. The cryptic splice site may be at least 20 nucleotides downstream of the NIE 3' splice site. The cryptic splice site may be at least 50 nucleotides downstream of the NIE 3' splice site. The cryptic splice site may be at least 100 nucleotides downstream of the NIE 3' splice site. The cryptic splice site may be at least 200 nucleotides downstream of the NIE 3' splice site.

Target Transcripts

In some embodiments, the methods of the present disclosure exploit the presence of NIE in the pre-mRNA transcribed from the SCN1A gene. Splicing of the identified SCN1A NIE pre-mRNA species to produce functional mature SCN1A mRNA can be induced using a therapeutic agent such as an ASO that stimulates exon skipping of an NIE. Induction of exon skipping can result in inhibition of an NMD pathway. The resulting mature SCN1A mRNA can be translated normally without activating NMD pathway, thereby increasing the amount of SCN1A protein in the patient's cells and alleviating symptoms of a condition associated with SCN1A deficiency, such as Dravet Syndrome (DS); Epilepsy, generalized, with febrile seizures plus, type 2; Febrile seizures, familial, 3A; Autism; Epileptic encephalopathy, early infantile, 13; Sick sinus syndrome 1; Alzheimer's disease; or SUDEP.

In various embodiments, the present disclosure provides a therapeutic agent which can target SCN1A mRNA transcripts to modulate, e.g., enhance or inhibit, splicing or protein expression level. The therapeutic agent can be a small molecule, polynucleotide, or polypeptide. In some embodiments, the therapeutic agent is an ASO. Various regions or sequences on the SCN1A pre-mRNA can be targeted by a therapeutic agent, such as an ASO. In some embodiments, the ASO targets a SCN1A pre-mRNA transcript containing an NIE. In some embodiments, the ASO targets a sequence within an NIE of a SCN1A pre-mRNA transcript. In some embodiments, the ASO targets a sequence upstream (or 5') from the 5' end of an NIE (3'ss) of a SCN1A pre-mRNA transcript. In some embodiments, the ASO targets a sequence downstream (or 3') from the 3' end of an NIE (5'ss) of a SCN1A pre-mRNA transcript. In some embodiments, the ASO targets a sequence that is within an intron flanking on the 5' end of the NIE of a SCN1A pre-mRNA transcript. In some embodiments, the ASO targets a sequence that is within an intron flanking the 3' end of the NIE of a SCN1A pre-mRNA transcript. In some embodiments, the ASO targets a sequence comprising an NIE-intron boundary of a SCN1A pre-mRNA transcript. An NIE-intron boundary can refer to the junction of an intron sequence and an NIE region. The intron sequence can flank the 5' end of the NIE, or the 3' end of the NIE. In some embodiments, the ASO targets a sequence within an exon of a SCN1A pre-mRNA transcript. In some embodiments, the ASO targets a sequence within an intron of a SCN1A pre-mRNA transcript. In some embodiments, the ASO targets a sequence comprising both a portion of an intron and a portion of an exon.

In some embodiments, a therapeutic agent described herein modulates binding of a factor involved in splicing of the NMD exon mRNA.

In some embodiments, a therapeutic agent described herein interferes with binding of a factor involved in splicing of the NMD exon mRNA.

In some embodiments, a therapeutic agent described herein prevents binding of a factor involved in splicing of the NMD exon mRNA.

In some embodiments, a therapeutic agent targets a targeted portion located in an intronic region between two canonical exonic regions of the NMD exon mRNA encoding SCN1A, and wherein the intronic region contains the NMD exon.

In some embodiments, a therapeutic agent targets a targeted portion at least partially overlaps with the NMD exon.

In some embodiments, a therapeutic agent targets a targeted portion that is at least partially overlaps with an intron upstream of the NMD exon.

In some embodiments, a therapeutic agent targets a targeted portion within the NMD exon.

In some embodiments, a therapeutic agent targets a targeted portion comprising at least about 5, 6, 7, 8, 9, 10, 11, 12, 13, 14, 15, 16, 17, 18, 19, 20, 21, 22, 23, 24, 25, 26, 27, 28, 29, 30, or more consecutive nucleotides of the NMD exon. In some embodiments, a therapeutic agent targets a targeted portion comprising at most about 5, 6, 7, 8, 9, 10, 11, 12, 13, 14, 15, 16, 17, 18, 19, 20, 21, 22, 23, 24, 25, 26, 27, 28, 29, 30, or more consecutive nucleotides of the NMD exon. In some embodiments, a therapeutic agent targets a targeted portion comprising about 5, 6, 7, 8, 9, 10, 11, 12, 13, 14, 15, 16, 17, 18, 19, 20, 21, 22, 23, 24, 25, 26, 27, 28, 29, 30, or more consecutive nucleotides of the NMD exon.

In some embodiments, a therapeutic agent targets a targeted portion proximal to the NMD exon.

In some embodiments, the ASO targets a sequence from about 4 to about 300 nucleotides upstream (or 5') from the 5' end of the NIE. In some embodiments, the ASO targets a sequence from about 1 to about 20 nucleotides, about 20 to about 50 nucleotides, about 50 to about 100 nucleotides, about 100 to about 150 nucleotides, about 150 to about 200 nucleotides, about 200 to about 250 nucleotides, about 250 to about 300, about 250 to about 300 nucleotides, about 350 to about 400 nucleotides, about 450 to about 500 nucleotides, about 550 to about 600 nucleotides, about 650 to about 700 nucleotides, about 750 to about 800 nucleotides, about 850 to about 900 nucleotides, about 950 to about 1000 nucleotides, about 1050 to about 1100 nucleotides, about 1150 to about 1200 nucleotides, about 1250 to about 1300 nucleotides, about 1350 to about 1400 nucleotides, or about 1450 to about 1500 nucleotides upstream (or 5') from the 5' end of the NIE region. In some embodiments, the ASO may target a sequence more than 300 nucleotides upstream from the 5' end of the NIE. In some embodiments, the ASO targets a sequence from about 4 to about 300 nucleotides downstream (or 3') from the 3' end of the NIE. In some embodiments, the ASO targets a sequence about 1 to about 20 nucleotides, about 20 to about 50 nucleotides, about 50 to about 100 nucleotides, about 100 to about 150 nucleotides, about 150 to about 200 nucleotides, about 200 to about 250 nucleotides, about 250 to about 300 nucleotides, about 350 to about 400 nucleotides, about 450 to about 500 nucleotides, about 550 to about 600 nucleotides, about 650 to about 700 nucleotides, about 750 to about 800 nucleotides, about 850 to about 900 nucleotides, about 950 to about 1000 nucleotides, about 1050 to about 1100 nucleotides, about 1150 to about 1200 nucleotides, about 1250 to about 1300 nucleotides, about 1350 to about 1400 nucleotides, or about 1450 to about 1500 nucleotides downstream from the 3' end of the NIE. In some embodiments, the ASO targets a sequence more than 300 nucleotides downstream from the 3' end of the NIE.

In some embodiments, the ASO targets a sequence from about 4 to about 300 nucleotides upstream (or 5') from the 5' end of the NIE. In some embodiments, the ASO targets a sequence at least about 1 nucleotide, at least about 10 nucleotides, at least about 20 nucleotides, at least about 50 nucleotides, at least about 80 nucleotides, at least about 85 nucleotides, at least about 90 nucleotides, at least about 95 nucleotides, at least about 96 nucleotides, at least about 97 nucleotides, at least about 98 nucleotides, at least about 99 nucleotides, at least about 100 nucleotides, at least about 101 nucleotides, at least about 102 nucleotides, at least about 103 nucleotides, at least about 104 nucleotides, at least about 105 nucleotides, at least about 110 nucleotides, at least about 120 nucleotides, at least about 150 nucleotides, at least about 200 nucleotides, at least about 300 nucleotides, at least about 400 nucleotides, at least about 500 nucleotides, at least about 600 nucleotides, at least about 700 nucleotides, at least about 800 nucleotides, at least about 900 nucleotides, or at least about 1000 nucleotides upstream (or 5') from the 5' end of the NIE region. In some embodiments, the ASO targets a sequence about 4 to about 300 nucleotides downstream (or 3') from the 3' end of the NIE. In some embodiments, the ASO targets a sequence at least about 1 nucleotide, at least about 10 nucleotides, at least about 20 nucleotides, at least about 50 nucleotides, at least about 80 nucleotides, at least about 85 nucleotides, at least about 90 nucleotides, at least about 95 nucleotides, at least about 96 nucleotides, at least about 97 nucleotides, at least about 98 nucleotides, at least about 99 nucleotides, at least about 100 nucleotides, at least about 101 nucleotides, at least about 102 nucleotides, at least about 103 nucleotides, at least about 104 nucleotides, at least about 105 nucleotides, at least about 110 nucleotides, at least about 120 nucleotides, at least about 150 nucleotides, at least about 200 nucleotides, at least about 300 nucleotides, at least about 400 nucleotides, at least about 500 nucleotides, at least about 600 nucleotides, at least about 700 nucleotides, at least about 800 nucleotides, at least about 900 nucleotides, or at least about 1000 nucleotides downstream from the 3' end of the NIE. In some embodiments, the ASO targets a sequence more than 300 nucleotides downstream from the 3' end of the NIE.

In some embodiments, the ASO targets a sequence from about 4 to about 300 nucleotides upstream (or 5') from the 5' end of the NIE. In some embodiments, the ASO targets a sequence at most about 10 nucleotides, at most about 20 nucleotides, at most about 50 nucleotides, at most about 80 nucleotides, at most about 85 nucleotides, at most about 90 nucleotides, at most about 95 nucleotides, at most about 96 nucleotides, at most about 97 nucleotides, at most about 98 nucleotides, at most about 99 nucleotides, at most about 100 nucleotides, at most about 101 nucleotides, at most about 102 nucleotides, at most about 103 nucleotides, at most about 104 nucleotides, at most about 105 nucleotides, at most about 110 nucleotides, at most about 120 nucleotides, at most about 150 nucleotides, at most about 200 nucleotides, at most about 300 nucleotides, at most about 400 nucleotides, at most about 500 nucleotides, at most about 600 nucleotides, at most about 700 nucleotides, at most about 800 nucleotides, at most about 900 nucleotides, at most about 1000 nucleotides, at most about 1100 nucleotides, at most about 1200 nucleotides, at most about 1300 nucleotides, at most about 1400 nucleotides, or at most about 1500 nucleotides upstream (or 5') from the 5' end of the NIE region. In some embodiments, the ASO targets a sequence about 4 to about 300 nucleotides downstream (or 3') from the 3' end of the NIE. In some embodiments, the ASO targets a sequence at most about 10 nucleotides, at most about 20 nucleotides, at most about 50 nucleotides, at most about 80 nucleotides, at most about 85 nucleotides, at most about 90 nucleotides, at most about 95 nucleotides, at most about 96 nucleotides, at most about 97 nucleotides, at most about 98 nucleotides, at most about 99 nucleotides, at most about 100 nucleotides, at most about 101 nucleotides, at most about 102 nucleotides, at most about 103 nucleotides, at most about 104 nucleotides, at most about 105 nucleotides, at most about 110 nucleotides, at most about 120 nucleotides, at most about 150 nucleotides, at most about 200 nucleotides, at most about 300 nucleotides, at most about 400 nucleotides, at most about 500 nucleotides, at most about 600 nucleotides, at most about 700 nucleotides, at most about 800 nucleotides, at most about 900 nucleotides, or at most about 1000 nucleotides, at most about 1100 nucleotides, at most about 1200 nucleotides, at most about 1300 nucleotides, at most about 1400 nucleotides, or at most about 1500 nucleotides downstream from the 3' end of the NIE. In some embodiments, the ASO targets a sequence more than 300 nucleotides downstream from the 3' end of the NIE.

Figure 2:
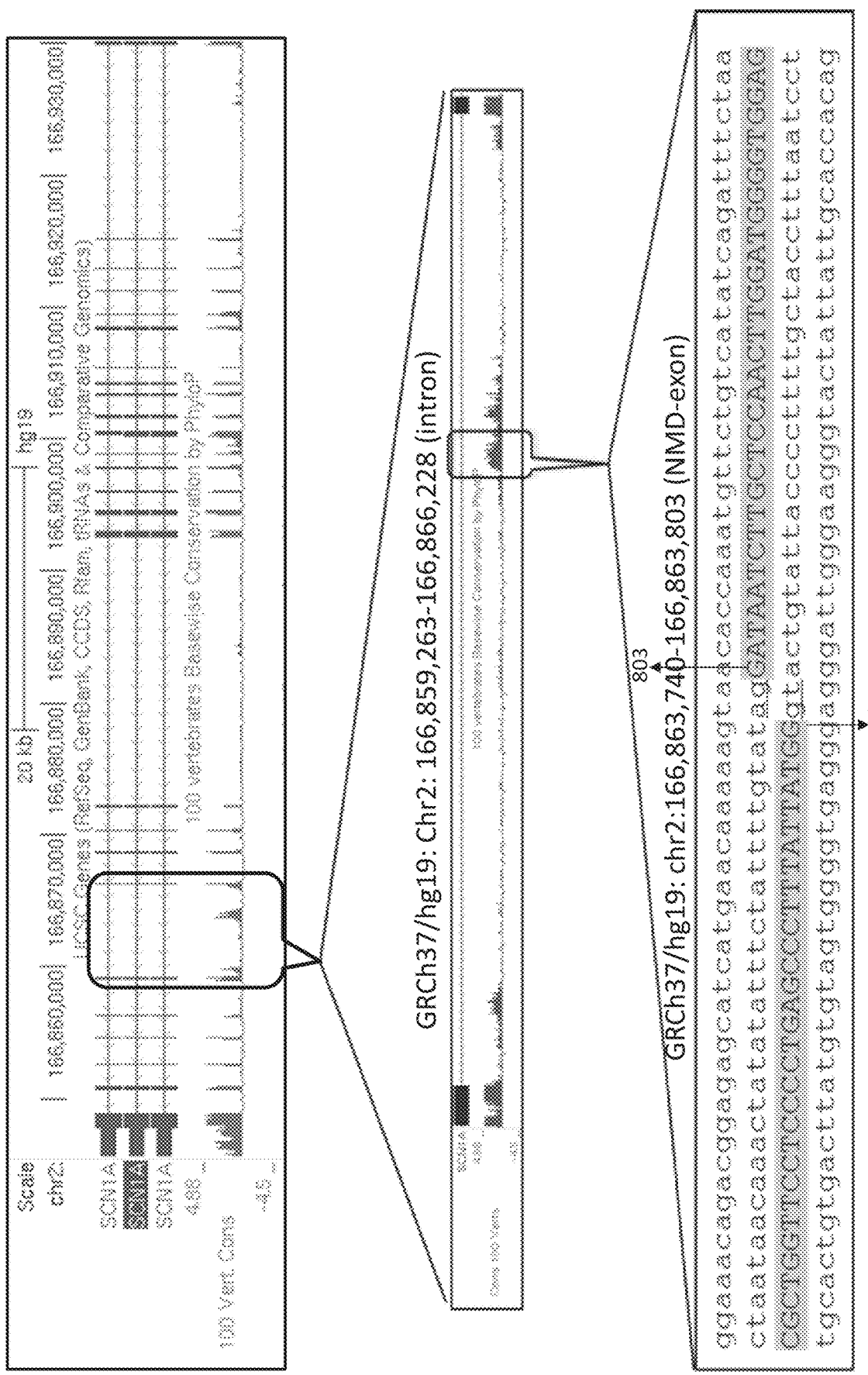
FIG. 2 depicts identification of an exemplary nonsense-mediated mRNA decay (NMD)-inducing exon in the SCN1A gene. The identification of the NMD-inducing exon in the SCN1A gene using comparative genomics is shown, visualized in the UCSC genome browser. The upper panel shows a graphic representation of the SCN1A gene to scale. The conservation level across 100 vertebrate species is shown as peaks. The highest peaks correspond to exons (black boxes), while no peaks are observed for the majority of the introns (lines with arrow heads). Peaks of conservation were identified in intron 20 (NM_006920), shown in the middle panel. Inspection of the conserved sequences identified an exon-like sequence of 64 bp (bottom panel, sequence highlighted in grey) flanked by 3' and 5' splice sites (underlined sequence). Inclusion of this exon leads to a frameshift and the introduction of a premature termination codon in exon 21 rendering the transcript a target of NMD.

In some embodiments, the NIE as described herein is located between GRCh37/hg19: chr2:166,863,740 and GRCh37/hg19: chr2:166,863,803, as depicted in FIG. 2. In some embodiments, the 5' end of the NIE is located at GRCh37/hg19: chr2:166,863,803. In some embodiments, the 3' end of the NIE is located at GRCh37/hg19: chr2:166, 863,740.

In some embodiments, In some embodiments, the ASO targets a sequence from about 4 to about 300 nucleotides upstream (or 5') from genomic site GRCh37/hg19: chr2:166,863,803. In some embodiments, the ASO targets a sequence about 1 to about 20 nucleotides, about 20 to about 50 nucleotides, about 50 to about 100 nucleotides, about 100 to about 150 nucleotides, about 150 to about 200 nucleotides, about 200 to about 250 nucleotides, about 250 to about 300, about 250 to about 300 nucleotides, about 350 to about 400 nucleotides, about 450 to about 500 nucleotides, about 550 to about 600 nucleotides, about 650 to about 700 nucleotides, about 750 to about 800 nucleotides, about 850 to about 900 nucleotides, about 950 to about 1000 nucleotides, about 1050 to about 1100 nucleotides, about 1150 to about 1200 nucleotides, about 1250 to about 1300 nucleotides, about 1350 to about 1400 nucleotides, or about 1450 to about 1500 nucleotides upstream (or 5') from genomic site GRCh37/hg19: chr2:166,863,803. In some embodiments, the ASO may target a sequence more than 300 nucleotides upstream from genomic site GRCh37/hg19: chr2:166,863, 803. In some embodiments, the ASO targets a sequence from about 4 to about 300 nucleotides downstream (or 3') from GRCh37/hg19: chr2:166,863,740. In some embodiments, the ASO targets a sequence about 1 to about 20 nucleotides, about 20 to about 50 nucleotides, about 50 to about 100 nucleotides, about 100 to about 150 nucleotides, about 150 to about 200 nucleotides, about 200 to about 250 nucleotides, about 250 to about 300 nucleotides, about 350 to about 400 nucleotides, about 450 to about 500 nucleotides, about 550 to about 600 nucleotides, about 650 to about 700 nucleotides, about 750 to about 800 nucleotides, about 850 to about 900 nucleotides, about 950 to about 1000 nucleotides, about 1050 to about 1100 nucleotides, about 1150 to about 1200 nucleotides, about 1250 to about 1300 nucleotides, about 1350 to about 1400 nucleotides, or about 1450 to about 1500 nucleotides downstream from GRCh37/hg19: chr2:166,863,740. In some embodiments, the ASO targets a sequence more than 300 nucleotides downstream from GRCh37/hg19: chr2: 166,863,740.

In some embodiments, the ASO targets a sequence from about 4 to about 300 nucleotides upstream (or 5') from genomic site GRCh37/hg19: chr2:166,863,803. In some embodiments, the ASO targets a sequence at least about 1 nucleotide, at least about 10 nucleotides, at least about 20 nucleotides, at least about 50 nucleotides, at least about 80 nucleotides, at least about 85 nucleotides, at least about 90 nucleotides, at least about 95 nucleotides, at least about 96 nucleotides, at least about 97 nucleotides, at least about 98 nucleotides, at least about 99 nucleotides, at least about 100 nucleotides, at least about 101 nucleotides, at least about 102 nucleotides, at least about 103 nucleotides, at least about 104 nucleotides, at least about 105 nucleotides, at least about 110 nucleotides, at least about 120 nucleotides, at least about 150 nucleotides, at least about 200 nucleotides, at least about 300 nucleotides, at least about 400 nucleotides, at least about 500 nucleotides, at least about 600 nucleotides, at least about 700 nucleotides, at least about 800 nucleotides, at least about 900 nucleotides, or at least about 1000 nucleotides upstream (or 5') from genomic site GRCh37/hg19: chr2:166,863,803. In some embodiments, the ASO targets a sequence from about 4 to about 300 nucleotides downstream (or 3') from GRCh37/hg19: chr2:166,863,740. In some embodiments, the ASO targets a sequence at least about 1 nucleotide, at least about 10 nucleotides, at least about 20 nucleotides, at least about 50 nucleotides, at least about 80 nucleotides, at least about 85 nucleotides, at least about 90 nucleotides, at least about 95 nucleotides, at least about 96 nucleotides, at least about 97 nucleotides, at least about 98 nucleotides, at least about 99 nucleotides, at least about 100 nucleotides, at least about 101 nucleotides, at least about 102 nucleotides, at least about 103 nucleotides, at least about 104 nucleotides, at least about 105 nucleotides, at least about 110 nucleotides, at least about 120 nucleotides, at least about 150 nucleotides, at least about 200 nucleotides, at least about 300 nucleotides, at least about 400 nucleotides, at least about 500 nucleotides, at least about 600 nucleotides, at least about 700 nucleotides, at least about 800 nucleotides, at least about 900 nucleotides, or at least about 1000 nucleotides downstream from GRCh37/hg19: chr2:166,863,740. In some embodiments, the ASO targets a sequence more than 300 nucleotides downstream from GRCh37/hg19: chr2:166,863,740.

In some embodiments, the ASO targets a sequence from about 4 to about 300 nucleotides upstream (or 5') from genomic site GRCh37/hg19: chr2:166,863,803. In some embodiments, the ASO targets a sequence at most about 10 nucleotides, at most about 20 nucleotides, at most about 50 nucleotides, at most about 80 nucleotides, at most about 85 nucleotides, at most about 90 nucleotides, at most about 95 nucleotides, at most about 96 nucleotides, at most about 97 nucleotides, at most about 98 nucleotides, at most about 99 nucleotides, at most about 100 nucleotides, at most about 101 nucleotides, at most about 102 nucleotides, at most about 103 nucleotides, at most about 104 nucleotides, at most about 105 nucleotides, at most about 110 nucleotides, at most about 120 nucleotides, at most about 150 nucleotides, at most about 200 nucleotides, at most about 300 nucleotides, at most about 400 nucleotides, at most about 500 nucleotides, at most about 600 nucleotides, at most about 700 nucleotides, at most about 800 nucleotides, at most about 900 nucleotides, at most about 1000 nucleotides, at most about 1100 nucleotides, at most about 1200 nucleotides, at most about 1300 nucleotides, at most about 1400 nucleotides, or at most about 1500 nucleotides upstream (or 5') from genomic site GRCh37/hg19: chr2:166,863,803. In some embodiments, the ASO targets a sequence from about 4 to about 300 nucleotides downstream (or 3') from GRCh37/hg19: chr2:166,863,740. In some embodiments, the ASO targets a sequence at most about 10 nucleotides, at most about 20 nucleotides, at most about 50 nucleotides, at most about 80 nucleotides, at most about 85 nucleotides, at most about 90 nucleotides, at most about 95 nucleotides, at most about 96 nucleotides, at most about 97 nucleotides, at most about 98 nucleotides, at most about 99 nucleotides, at most about 100 nucleotides, at most about 101 nucleotides, at most about 102 nucleotides, at most about 103 nucleotides, at most about 104 nucleotides, at most about 105 nucleotides, at most about 110 nucleotides, at most about 120 nucleotides, at most about 150 nucleotides, at most about 200 nucleotides, at most about 300 nucleotides, at most about 400 nucleotides, at most about 500 nucleotides, at most about 600 nucleotides, at most about 700 nucleotides, at most about 800 nucleotides, at most about 900 nucleotides, or at most about 1000 nucleotides, at most about 1100 nucleotides, at most about 1200 nucleotides, at most about 1300 nucleotides, at most about 1400 nucleotides, or at most about 1500 nucleotides downstream from GRCh37/hg19: chr2:166,863,740. In some embodiments, the ASO targets a sequence more than 300 nucleotides downstream from GRCh37/hg19: chr2:166,863,740.

As described herein in the Examples, the SCN1A gene (SEQ ID NO. 1) was analyzed for NIE and inclusion of a portion of intron 20 (SEQ ID NO. 4) (this portion is referred as exon 20x throughout the present disclosure) was observed. In some embodiments, the ASOs disclosed herein target a NIE containing pre-mRNA (SEQ ID NO. 2) transcribed from a SCN1A genomic sequence. In some embodiments, the ASO targets a NIE containing pre-mRNA transcript from a SCN1A genomic sequence comprising a portion of intron 20. In some embodiments, the ASO targets a NIE containing pre-mRNA transcript from a SCN1A genomic sequence comprising exon 20x (SEQ ID NO. 6). In some embodiments, the ASO targets a NIE containing pre-mRNA transcript of SEQ ID NO. 2 or 12. In some embodiments, the ASO targets a NIE containing pre-mRNA transcript of SEQ ID NO. 2 or 12 comprising an NIE. In some embodiments, the ASO targets a NIE containing pre-mRNA transcript of SEQ ID NO. 2 comprising exon 20x (SEQ ID NO. 10). In some embodiments, the ASOs disclosed herein target a SCN1A pre-mRNA sequence (SEQ ID NO. 2 or 12). In some embodiments, the ASO targets a SCN1A pre-mRNA sequence comprising an NIE (SEQ ID NO. 10 or 20). In some embodiments, the ASO targets a SCN1A pre-mRNA sequence according to any one of SEQ ID NOs: 7-10 or 17-20. In some embodiments, the ASO has a sequence according to any one of SEQ ID NOs: 21-67. In some embodiments, the ASO has a sequence according to any one of SEQ ID NOs: 68-114. In some embodiments, the ASO has a sequence according to any one of SEQ ID NOs: 115-209. In some embodiments, the ASO has a sequence according to any one of SEQ ID NOs: 210-256. In some embodiments, the ASO has a sequence according to any one of SEQ ID NOs: 257-303. In some embodiments, the ASO has a sequence according to any one of SEQ ID NOs: 304-341. In some embodiments, the ASO has a sequence according to any one of SEQ ID NOs: 342-379.

In some embodiments, the SCN1A NIE containing pre-mRNA transcript is encoded by a genetic sequence with at least about 80%, 85%, 90%, 95%, 96%, 97%, 98%, 99% or 100% sequence identity to SEQ ID NO.: 1 or 11. In some embodiments, the SCN1A NIE pre-mRNA transcript comprises a sequence with at least about 80%, 85%, 90%, 95%, 96%, 97%, 98%, 99% or 100% sequence identity to any one of SEQ ID NOs.: 2-10 and 12-20.

In some embodiments, the SCN1A NIE containing pre-mRNA transcript (or NMD exon mRNA) comprises a sequence with at least about 80%, 85%, 90%, 95%, 97%, or 100% sequence identity to any one of SEQ ID NOs: 2, 7-10, 12, and 17-20. In some embodiments, SCN1A NIE containing pre-mRNA transcript (or NMD exon mRNA) is encoded by a sequence with at least about 80%, 85%, 90%, 95%, 97%, or 100% sequence identity to SEQ ID NOs: 1, 3-6, 11, and 13-16. In some embodiments, the targeted portion of the NMD exon mRNA comprises a sequence with at least 80%, 85%, 90%, 95%, 97%, or 100% sequence identity to a region comprising at least 8 contiguous nucleic acids of SEQ ID NOs: 2, 7-10, 12, and 17-20.

In some embodiments, the ASO targets exon 20 of a SCN1A NIE containing pre-mRNA comprising NIE exon 20x. In some embodiments, the ASO targets an exon 21 sequence downstream (or 3') of NIE exon 20x. In some embodiments, the ASO targets a sequence about 4 to about 300 nucleotides upstream (or 5') from the 5' end of exon 20x. In some embodiments, the ASO targets a sequence about 4 to about 300 nucleotides downstream (or 3') from the 3' end of exon 20x. In some embodiments, the ASO has a sequence according to any one of SEQ ID NOs: 21-67. In some embodiments, the ASO has a sequence according to any one of SEQ ID NOs: 210-256.

In some embodiments, the ASO targets a sequence upstream from the 5' end of an NIE. For example, ASOs targeting a sequence upstream from the 5' end of an NIE (e.g. exon 20x in human SCN1A, or exon 21x in mouse SCN1A) can comprise a sequence with at least 80%, 85%, 90%, 95%, 97%, or 100% sequence identity to any one of SEQ ID NOs: 21-38. For another example, ASOs targeting a sequence upstream from the 5' end of an NIE (e.g. exon 20x in human SCN1A, or exon 21x in mouse SCN1A) can comprise a sequence with at least 80%, 85%, 90%, 95%, 97%, or 100% sequence identity to any one of SEQ ID NOs: 68-85. In some embodiments, the ASOs target a sequence containing a exon-intron boundary (or junction). For example, ASOs targeting a sequence containing an exon-intron boundary can comprise a sequence with at least 80%, 85%, 90%, 95%, 97%, or 100% sequence identity to any one of SEQ ID NOs: 39-41, 51, 52, 228-230, 240, or 241. For another example, ASOs targeting a sequence containing an exon-intron boundary can comprise a sequence with at least 80%, 85%, 90%, 95%, 97%, or 100% sequence identity to any one of SEQ ID NOs: 86-88 and 98-99. In some embodiments, the ASOs target a sequence downstream from the 3' end of an NIE. For example, ASOs targeting a sequence downstream from the 3' end of an NIE (e.g. exon 20x in human SCN1A, or exon 21x in mouse SCN1A) can comprise a sequence with at least 80%, 85%, 90%, 95%, 97%, or 100% sequence identity to any one of SEQ ID NOs: 53-67. For another example, ASOs targeting a sequence downstream from the 3' end of an NIE (e.g. exon 20x in human SCN1A, or exon 21x in mouse SCN1A) can comprise a sequence with at least 80%, 85%, 90%, 95%, 97%, or 100% sequence identity to any one of SEQ ID NOs: 100-114. In some embodiments, ASOs target a sequence within an NIE. For example, ASOs targeting a sequence within an NIE (e.g. exon 20x in human SCN1A, or exon 21x in mouse SCN1A) can comprise a sequence with at least 80%, 85%, 90%, 95%, 97%, or 100% sequence identity to any one of SEQ ID NOs: 42-50, or 231-239. For another example, ASOs targeting a sequence within an NIE (e.g. exon 20x in human SCN1A, or exon 21x in mouse SCN1A) can comprise a sequence with at least 80%, 85%, 90%, 95%, 97%, or 100% sequence identity to any one of SEQ ID NOs: 89-97.

In some embodiments, the ASO targets exon 20x in a SCN1A NIE containing pre-mRNA comprising exon 20x. In some embodiments, the ASO targets an exon 20x sequence downstream (or 3') from the 5' end of the exon 20x of a SCN1A pre-mRNA. In some embodiments, the ASO targets an exon 20x sequence upstream (or 5') from the 3' end of the exon 20x of a SCN1A pre-mRNA.

In some embodiments, the targeted portion of the SCN1A NIE containing pre-mRNA is in intron 1, 2, 3, 4, 5, 6, 7, 8, 9, 10, 11, 12, 13, 14, 15, 16, 17, 18, 19, 20, 21, 22, 23, 24, or 25 (intron numbering corresponding to the mRNA sequence at NM_006920). In some embodiments, hybridization of an ASO to the targeted portion of the NIE pre-mRNA results in exon skipping of at least one of NIE within intron 1, 2, 3, 4, 5, 6, 7, 8, 9, 10, 11, 12, 13, 14, 15, 16, 17, 18, 19, 20, 21, 22, 23, 24, or 25, and subsequently increases SCN1A protein production. In some embodiments, hybridization of an ASO to the targeted portion of the NIE pre-mRNA inhibits or blocks exon skipping of at least one of NIE within intron 1, 2, 3, 4, 5, 6, 7, 8, 9, 10, 11, 12, 13, 14, 15, 16, 17, 18, 19, 20, 21, 22, 23, 24, or 25, and subsequently decreases SCN1A protein production. In some embodiments, the targeted portion of the SCN1A NIE containing pre-mRNA is in intron 20. One of skill in the art can determine the corresponding intron number in any isoform based on an intron sequence provided herein or using the number provided in reference to the mRNA sequence at NM_006920, NM_001202435, NM_001165964, or NM_001165963. One of skill in the art also can determine the sequences of flanking exons in any SCN1A isoform for targeting using the methods of the invention, based on an intron sequence provided herein or using the intron number provided in reference to the mRNA sequence at NM_006920, NM_001202435, NM_001165964, or NM_001165963.

In some embodiments, the methods and compositions of the present disclosure are used to modulate, e.g., increase or decrease, the expression of SCN1A by inducing or inhibiting exon skipping of a pseudo-exon of an SCN1A NIE containing pre-mRNA. In some embodiments, the pseudo-exon is a sequence within any of introns 1-25. In some embodiments, the pseudo-exon is a sequence within any of introns 2, 4, 6, 13, 14, 15, 16, 17, 18, 20, 21, 22, 23, 24, and 25. In some embodiments, the pseudo-exon is a sequence within any of introns 15, 18, and 19. In some embodiments, the pseudo-exon can be any SCN1A intron or a portion thereof. In some embodiments, the pseudo-exon is within intron 20. The SCN1A intron numbering used herein corresponds to the mRNA sequence at NM_006920. It is understood that the intron numbering may change in reference to a different SCN1A isoform sequence.

SCN1A Protein

The SCN1A gene can encode SCN1A (sodium channel, voltage-gated, type I, alpha subunit) protein, which can also be referred to as alpha-subunit of voltage-gated sodium channel Nav1.1. Also described above, SCN1A mutations in DS are spread across the entire protein. More than 100 novel mutations have been identified throughout the gene with the more debilitating arising de novo. These comprise of truncations (47%), missense (43%), deletions (3%), and splice site mutations (7%). The percentage of subjects carrying SCN1A mutations varies between 33 and 100%. The majority of mutations are novel changes (88%).

In some embodiments, the methods described herein are used to modulate, e.g., increase or decrease, the production of a functional SCN1A protein. As used herein, the term "functional" refers to the amount of activity or function of a SCN1A protein that is necessary to eliminate any one or more symptoms of a treated condition, e.g., Dravet syndrome; Epilepsy, generalized, with febrile seizures plus, type 2; Febrile seizures, familial, 3A; Autism; Epileptic encephalopathy, early infantile, 13; Sick sinus syndrome 1; Alzheimer's disease; or SUDEP. In some embodiments, the methods are used to increase the production of a partially functional SCN1A protein. As used herein, the term "partially functional" refers to any amount of activity or function of the SCN1A protein that is less than the amount of activity or function that is necessary to eliminate or prevent any one or more symptoms of a disease or condition. In some embodiments, a partially functional protein or RNA will have at least 10%, at least 20%, at least 30%, at least 40%, at least 50%, at least 60%, at least 70%, at least 75%, at least 80%, at least 85%, at least 90%, or at least 95% less activity relative to the fully functional protein or RNA.

In some embodiments, the method is a method of increasing the expression of the SCN1A protein by cells of a subject having a NIE containing pre-mRNA encoding the SCN1A protein, wherein the subject has Dravet syndrome caused by a deficient amount of activity of SCN1A protein, and wherein the deficient amount of the SCN1A protein is caused by haploinsufficiency of the SCN1A protein. In such an embodiment, the subject has a first allele encoding a functional SCN1A protein, and a second allele from which the SCN1A protein is not produced. In another such embodiment, the subject has a first allele encoding a functional SCN1A protein, and a second allele encoding a nonfunctional SCN1A protein. In another such embodiment, the subject has a first allele encoding a functional SCN1A protein, and a second allele encoding a partially functional SCN1A protein. In any of these embodiments, the antisense oligomer binds to a targeted portion of the NIE containing pre-mRNA transcribed from the second allele, thereby inducing exon skipping of the pseudo-exon from the pre-mRNA, and causing an increase in the level of mature mRNA encoding functional SCN1A protein, and an increase in the expression of the SCN1A protein in the cells of the subject.

In related embodiments, the method is a method of using an ASO to increase the expression of a protein or functional RNA. In some embodiments, an ASO is used to increase the expression of SCN1A protein in cells of a subject having a NIE containing pre-mRNA encoding SCN1A protein, wherein the subject has a deficiency, e.g., Dravet Syndrome (DS) (also known as SMEI); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); sick sinus syndrome 1; early infantile SCN1A encephalopathy; early infantile epileptic encephalopathy (EIEE); or autism, in the amount or function of a SCN1A protein. In some embodiments, an ASO is used to increase the expression of SCN1A protein in cells of a subject, wherein the subject has a deficiency, e.g., Epileptic encephalopathy, early infantile, 13; in the amount or function of a SCN8A protein. In some embodiments, an ASO is used to increase the expression of SCN1A protein in cells of a subject, wherein the subject has a deficiency, e.g., Sick sinus syndrome 1; in the amount or function of a SCN5A protein.

In some embodiments, the NIE containing pre-mRNA transcript that encodes the protein that is causative of the disease or condition is targeted by the ASOs described herein. In some embodiments, a NIE containing pre-mRNA transcript that encodes a protein that is not causative of the disease is targeted by the ASOs. For example, a disease that is the result of a mutation or deficiency of a first protein in a particular pathway may be ameliorated by targeting a NIE containing pre-mRNA that encodes a second protein, thereby increasing production of the second protein. In some embodiments, the function of the second protein is able to compensate for the mutation or deficiency of the first protein (which is causative of the disease or condition).

In some embodiments, the subject has:
(a) a first mutant allele from which
  (i) the SCN1A protein is produced at a reduced level compared to production from a wild-type allele,
  (ii) the SCN1A protein is produced in a form having reduced function compared to an equivalent wild-type protein, or
  (iii) the SCN1A protein or functional RNA is not produced; and
(b) a second mutant allele from which
  (i) the SCN1A protein is produced at a reduced level compared to production from a wild-type allele,
  (ii) the SCN1A protein is produced in a form having reduced function compared to an equivalent wild-type protein, or
  (iii) the SCN1A protein is not produced, and
wherein the NIE containing pre-mRNA is transcribed from the first allele and/or the second allele. In these embodiments, the ASO binds to a targeted portion of the NIE containing pre-mRNA transcribed from the first allele or the second allele, thereby inducing exon skipping of the pseudo-exon from the NIE containing pre-mRNA, and causing an increase in the level of mRNA encoding SCN1A protein and an increase in the expression of the target protein or functional RNA in the cells of the subject. In these embodiments, the target protein or functional RNA having an increase in expression level resulting from the exon skipping of the pseudo-exon from the NIE containing pre-mRNA is either in a form having reduced function compared to the equivalent wild-type protein (partially-functional), or having full function compared to the equivalent wild-type protein (fully-functional).

In some embodiments, the level of mRNA encoding SCN1A protein is increased 1.1 to 10-fold, when compared to the amount of mRNA encoding SCN1A protein that is produced in a control cell, e.g., one that is not treated with the antisense oligomer or one that is treated with an antisense oligomer that does not bind to the targeted portion of the SCN1A NIE containing pre-mRNA.

In some embodiments, a subject treated using the methods of the present disclosure expresses a partially functional SCN1A protein from one allele, wherein the partially functional SCN1A protein is caused by a frameshift mutation, a nonsense mutation, a missense mutation, or a partial gene deletion. In some embodiments, a subject treated using the methods of the invention expresses a nonfunctional SCN1A protein from one allele, wherein the nonfunctional SCN1A protein is caused by a frameshift mutation, a nonsense mutation, a missense mutation, a partial gene deletion, in one allele. In some embodiments, a subject treated using the methods of the invention has a SCN1A whole gene deletion, in one allele.

In some embodiments, the method is a method of decreasing the expression of the SCN1A protein by cells of a subject having a NIE containing pre-mRNA encoding the SCN1A protein, and wherein the subject has a gain-of-function mutation in $Na_v1.1$. In such an embodiment, the subject has an allele from which the SCN1A protein is produced in an elevated amount or an allele encoding a mutant SCN1A that induces increased activity of $Na_v1.1$ in the cell. In some embodiments, the increased activity of $Na_v1.1$ is characterized by a prolonged or near persistent sodium current mediated by the mutant Nav1.1 channel, a slowing of fast inactivation, a positive shift in steady-state inactivation, higher channel availability during repetitive stimulation, increased non-inactivated depolarization-induced persistent sodium currents, delayed entry into inactivation, accelerated recovery from fast inactivation, and/or rescue of folding defects by incubation at lower temperature or co-expression of interacting proteins. In any of these embodiments, the antisense oligomer binds to a targeted portion of the NIE containing pre-mRNA transcribed from the second allele, thereby inhibiting or blocking exon skipping of the pseudo-exon from the pre-mRNA, and causing a decrease in the level of mature mRNA encoding functional SCN1A protein, and a decrease in the expression of the SCN1A protein in the cells of the subject.

In related embodiments, the method is a method of using an ASO to decrease the expression of a protein or functional RNA. In some embodiments, an ASO is used to decrease the expression of SCN1A protein in cells of a subject having a NIE containing pre-mRNA encoding SCN1A protein. In some embodiments, the subject has a gain-of-function mutation in Nav1.1, e.g., migraine. In some embodiments, an ASO is used to decrease the expression of SCN1A protein in cells of a subject, the subject has a gain-of-function mutation in Nav1.1, e.g., migraine, familial hemiplegic, 3.

In some embodiments, the level of mRNA encoding SCN1A protein is decreased 1.1 to 10-fold, when compared to the amount of mRNA encoding SCN1A protein that is produced in a control cell, e.g., one that is not treated with the antisense oligomer or one that is treated with an antisense oligomer that does not bind to the targeted portion of the SCN1A NIE containing pre-mRNA.

In some embodiments, a subject treated using the methods of the present disclosure expresses a mutant SCN1A protein from one allele, wherein the mutant SCN1A protein is caused by a frameshift mutation, a nonsense mutation, a missense mutation, or a partial gene deletion, and wherein the mutant SCN1A protein causes an elevated activity level of $Na_v1.1$. In some embodiments, a subject treated using the methods of the present disclosure expresses an elevated amount of SCN1A protein from one allele due to a frameshift mutation, a nonsense mutation, a missense mutation, or a partial gene deletion.

In embodiments of the present invention, a subject can have a mutation in SCN1A. Mutations in SCN1A can be spread throughout said gene. SCN1A protein can consist of four domains. Said SCN1A domains can have transmembrane segments. Mutations in said SCN1A protein may arise throughout said protein. Said SCN1A protein may consist of at least two isoforms. Mutations in SCN1A may comprise of R931C, R946C, M934I, R1648C, or R1648H. In some cases, mutations may be observed in a C-terminus of a SCN1A protein. Mutations in a SCN1A protein may also be found in loops between segments 5 and 6 of the first three domains of said SCN1A protein. In some cases, mutations may be observed in an N-terminus of a SCN1A protein. Exemplary mutations within SCN1A include, but are not limited to, R222X, R712X, I227S, R1892X, W952X, R1245X, R1407X, W1434R, c.4338+1G>A, S1516X, L1670fsX1678, or K1846fsX1856. Mutations that can be targeted with the present invention may also encode a pore of an ion channel.

In some embodiments, the methods and compositions described herein can be used to treat DS. In other embodiments, the methods and compositions described herein can be used to treat severe myclonic epilepsy of infancy (SMEI). In other embodiments, the methods and compositions described herein can be used to treat borderline Dravet syndrome; Epilepsy, generalized, with febrile seizures plus, type 2; Febrile seizures, familial, 3A; Migraine, familial hemiplegic, 3; Autism; Epileptic encephalopathy, early infantile, 13; Sick sinus syndrome 1; Alzheimer's disease or SUDEP. The methods and compositions described herein can also be used to treat borderline SMEI. Additionally, the methods and compositions described herein can be used to treat generalized epilepsy with febrile seizures plus (GEFS+). GEFS+ may be associated with mutations in epilepsy-associated ion channel subunits such as SCN1B or GABRG2. The methods and compositions described herein can also be used to treat sodium channelopathies. Sodium channelopathies may be associated with mutations in SCN1A. Sodium channelopathies may also be associated with subunits of SCN1A, such as the beta subunit, SCN1B. In some cases, additional diseases associated with SCN1A mutations may also be treated with the present disclosure. Related SCN1A diseases associated with SCN1A mutations include, but are not limited to, atypical myotonia congenita, hyperkalemic periodic paralysis, and paramyotonia congenita.

In some embodiments, a subject having any SCN1A mutation known in the art and described in the literature referenced above (e.g., by Hamdan, et al., 2009, Mulley, et al., 2005) can be treated using the methods and compositions described herein. In some embodiments, the mutation is within any SCN1A intron or exon.

Exon Inclusion

As used herein, a "NIE containing pre-mRNA" is a pre-mRNA transcript that contains at least one pseudo-exon. Alternative or aberrant splicing can result in inclusion of the at least one pseudo-exon in the mature mRNA transcripts. The terms "mature mRNA," and "fully-spliced mRNA," are used interchangeably herein to describe a fully processed mRNA. Inclusion of the at least one pseudo-exon can be non-productive mRNA and lead to NMD of the mature mRNA. NIE containing mature mRNA may sometimes lead to aberrant protein expression.

In some embodiments, the included pseudo-exon is the most abundant pseudo-exon in a population of NIE containing pre-mRNAs transcribed from the gene encoding the target protein in a cell. In some embodiments, the included pseudo-exon is the most abundant pseudo-exon in a population of NIE containing pre-mRNAs transcribed from the gene encoding the target protein in a cell, wherein the population of NIE containing pre-mRNAs comprises two or more included pseudo-exons. In some embodiments, an antisense oligomer targeted to the most abundant pseudo-exon in the population of NIE containing pre-mRNAs encoding the target protein induces exon skipping of one or two or more pseudo-exons in the population, including the pseudo-exon to which the antisense oligomer is targeted or binds. In embodiments, the targeted region is in a pseudo-exon that is the most abundant pseudo-exon in a NIE containing pre-mRNA encoding the SCN1A protein.

The degree of exon inclusion can be expressed as percent exon inclusion, e.g., the percentage of transcripts in which a given pseudo-exon is included. In brief, percent exon inclusion can be calculated as the percentage of the amount of RNA transcripts with the exon inclusion, over the sum of the average of the amount of RNA transcripts with exon inclusion plus the average of the amount of RNA transcripts with exon exclusion.

In some embodiments, an included pseudo-exon is an exon that is identified as an included pseudo-exon based on a determination of at least about 5%, at least about 10%, at least about 15%, at least about 20%, at least about 25%, at least about 30%, at least about 35%, at least about 40%, at least about 45%, or at least about 50%, inclusion. In embodiments, a included pseudo-exon is an exon that is identified as a included pseudo-exon based on a determination of about 5% to about 100%, about 5% to about 95%, about 5% to about 90%, about 5% to about 85%, about 5% to about 80%, about 5% to about 75%, about 5% to about 70%, about 5% to about 65%, about 5% to about 60%, about 5% to about 55%, about 5% to about 50%, about 5% to about 45%, about 5% to about 40%, about 5% to about 35%, about 5% to about 30%, about 5% to about 25%, about 5% to about 20%, about 5% to about 15%, about 10% to about 100%, about 10% to about 95%, about 10% to about 90%, about 10% to about 85%, about 10% to about 80%, about 10% to about 75%, about 10% to about 70%, about 10% to about 65%, about 10% to about 60%, about 10% to about 55%, about 10% to about 50%, about 10% to about 45%, about 10% to about 40%, about 10% to about 35%, about 10% to about 30%, about 10% to about 25%, about 10% to about 20%, about 15% to about 100%, about 15% to about 95%, about 15% to about 90%, about 15% to about 85%, about 15% to about 80%, about 15% to about 75%, about 15% to about 70%, about 15% to about 65%, about 15% to about 60%, about 15% to about 55%, about 15% to about 50%, about 15% to about 45%, about 15% to about 40%, about 15% to about 35%, about 15% to about 30%, about 15% to about 25%, about 20% to about 100%, about 20% to about 95%, about 20% to about 90%, about 20% to about 85%, about 20% to about 80%, about 20% to about 75%, about 20% to about 70%, about 20% to about 65%, about 20% to about 60%, about 20% to about 55%, about 20% to about 50%, about 20% to about 45%, about 20% to about 40%, about 20% to about 35%, about 20% to about 30%, about 25% to about 100%, about 25% to about 95%, about 25% to about 90%, about 25% to about 85%, about 25% to about 80%, about 25% to about 75%, about 25% to about 70%, about 25% to about 65%, about 25% to about 60%, about 25% to about 55%, about 25% to about 50%, about 25% to about 45%, about 25% to about 40%, or about 25% to about 35%, inclusion. ENCODE data (described by, e.g., Tilgner, et al., 2012, "Deep sequencing of subcellular RNA fractions shows splicing to be predominantly co-transcriptional in the human genome but inefficient for lncRNAs," Genome Research 22(9):1616-25) can be used to aid in identifying exon inclusion.

In some embodiments, contacting cells with an ASO that is complementary to a targeted portion of a SCN1A pre-mRNA transcript results in an increase in the amount of SCN1A protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In some embodiments, the total amount of SCN1A protein produced by the cell to which the antisense oligomer is contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by a control compound. A control compound can be, for example, an oligonucleotide that is not complementary to a targeted portion of the pre-mRNA.

In some embodiments, contacting cells with an ASO that is complementary to a targeted portion of a SCN1A pre-mRNA transcript results in a decrease in the amount of SCN1A protein produced by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In some embodiments, the total amount of SCN1A protein produced by the cell to which the antisense oligomer is contacted is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the amount of target protein produced by a control compound. A control compound can be, for example, an oligonucleotide that is not complementary to a targeted portion of the pre-mRNA.

In some embodiments, contacting cells with an ASO that is complementary to a targeted portion of a SCN1A pre-mRNA transcript results in an increase in the amount of mRNA encoding SCN1A, including the mature mRNA encoding the target protein. In some embodiments, the amount of mRNA encoding SCN1A protein, or the mature mRNA encoding the SCN1A protein, is increased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In some embodiments, the total amount of the mRNA encoding SCN1A protein, or the mature mRNA encoding SCN1A protein produced in the cell to which the antisense oligomer is contacted is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to a targeted portion of the SCN1A NIE containing pre-mRNA.

In some embodiments, contacting cells with an ASO that is complementary to a targeted portion of a SCN1A pre-mRNA transcript results in a decrease in the amount of mRNA encoding SCN1A, including the mature mRNA encoding the target protein. In some embodiments, the amount of mRNA encoding SCN1A protein, or the mature mRNA encoding the SCN1A protein, is decreased by at least 10, 20, 30, 40, 50, 60, 80, 100, 150, 200, 250, 300, 350, 400, 450, 500, or 1000%, compared to the amount of the protein produced by a cell in the absence of the ASO/absence of treatment. In some embodiments, the total amount of the mRNA encoding SCN1A protein, or the mature mRNA encoding SCN1A protein produced in the cell to which the antisense oligomer is contacted is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold compared to the amount of mature RNA produced in an untreated cell, e.g., an untreated cell or a cell treated with a control compound. A control compound can be, for example, an oligonucleotide that is not complementary to a targeted portion of the SCN1A NIE containing pre-mRNA.

The NIE can be in any length. In some embodiments, the NIE comprises a full sequence of an intron, in which case, it can be referred to as intron retention. In some embodiments, the NIE can be a portion of the intron. In some embodiments, the NIE can be a 5' end portion of an intron including a 5'ss sequence. In some embodiments, the NIE can be a 3' end portion of an intron including a 3'ss sequence. In some embodiments, the NIE can be a portion within an intron without inclusion of a 5'ss sequence. In some embodiments, the NIE can be a portion within an intron without inclusion of a 3'ss sequence. In some embodiments, the NIE can be a portion within an intron without inclusion of either a 5'ss or a 3'ss sequence. In some embodiments, the NIE can be from 5 nucleotides to 10 nucleotides in length, from 10 nucleotides to 15 nucleotides in length, from 15 nucleotides to 20 nucleotides in length, from 20 nucleotides to 25 nucleotides in length, from 25 nucleotides to 30 nucleotides in length, from 30 nucleotides to 35 nucleotides in length, from 35 nucleotides to 40 nucleotides in length, from 40 nucleotides to 45 nucleotides in length, from 45 nucleotides to 50 nucleotides in length, from 50 nucleotides to 55 nucleotides in length, from 55 nucleotides to 60 nucleotides in length, from 60 nucleotides to 65 nucleotides in length, from 65 nucleotides to 70 nucleotides in length, from 70 nucleotides to 75 nucleotides in length, from 75 nucleotides to 80 nucleotides in length, from 80 nucleotides to 85 nucleotides in length, from 85 nucleotides to 90 nucleotides in length, from 90 nucleotides to 95 nucleotides in length, or from 95 nucleotides to 100 nucleotides in length. In some embodiments, the NIE can be at least 10 nucleotides, at least 20 nucleotides, at least 30 nucleotides, at least 40 nucleotides, at least 50 nucleotides, at least 60 nucleotides, at least 70 nucleotides, at least 80 nucleotides in length, at least 90 nucleotides, or at least 100 nucleotides in length. In some embodiments, the NIE can be from 100 to 200 nucleotides in length, from 200 to 300 nucleotides in length, from 300 to 400 nucleotides in length, from 400 to 500 nucleotides in length, from 500 to 600 nucleotides in length, from 600 to 700 nucleotides in length, from 700 to 800 nucleotides in length, from 800 to 900 nucleotides in length, from 900 to 1,000 nucleotides in length. In some embodiments, the NIE may be longer than 1,000 nucleotides in length.

Inclusion of a pseudo-exon can lead to a frameshift and the introduction of a premature termination codon (PIC) in the mature mRNA transcript rendering the transcript a target of NMD. Mature mRNA transcript containing NIE can be non-productive mRNA transcript which does not lead to protein expression. The PIC can be present in any position downstream of an NIE. In some embodiments, the PIC can be present in any exon downstream of an NIE. In some embodiments, the PIC can be present within the NIE. For example, inclusion of exon 20x in an mRNA transcript encoded by the SCN1A gene can induce a PIC in the mRNA transcript, e.g., a PIC in exon 21 of the mRNA transcript.

Therapeutic Agents

In various embodiments of the present disclosure, compositions and methods comprising a therapeutic agent are provided to modulate protein expression level of SCN1A. In some embodiments, provided herein are compositions and methods to modulate alternative splicing of SCN1A pre-mRNA. In some embodiments, provided herein are compositions and methods to induce exon skipping in the splicing of SCN1A pre-mRNA, e.g., to induce skipping of a pseudo-exon during splicing of SCN1A pre-mRNA. In other embodiments, therapeutic agents may be used to induce the inclusion of an exon in order to decrease the protein expression level.

In some embodiment, a therapeutic agent disclosed herein is a small molecule, a polypeptide, or a polynucleic acid polymer. In some instances, the therapeutic agent is a small molecule. In some instances, the therapeutic agent is a polypeptide. In some instances, the therapeutic agent is a polynucleic acid polymer. In some cases, the therapeutic agent is a repressor agent. In additional cases, the therapeutic agent is an enhancer agent.

A therapeutic agent disclosed herein can be a NIE repressor agent. A therapeutic agent may comprise a polynucleic acid polymer.

According to one aspect of the present disclosure, provided herein is a method of treatment or prevention of a condition associated with a functional-SCN1A protein deficiency, comprising administering a NIE repressor agent to a subject to increase levels of functional SCN1A protein, wherein the agent binds to a region of the pre-mRNA transcript to decrease inclusion of the NIE in the mature transcript. For example, provided herein is a method of treatment or prevention of a condition associated with a functional-SCN1A protein deficiency, comprising administering a NIE repressor agent to a subject to increase levels of functional SCN1A protein, wherein the agent binds to a region of an intron containing an NIE (e.g., intron 20 in human SCN1A gene) of the pre-mRNA transcript or to a NIE-activating regulatory sequence in the same intron.

Where reference is made to reducing NIE inclusion in the mature mRNA, the reduction may be complete, e.g., 100%, or may be partial. The reduction may be clinically significant. The reduction/correction may be relative to the level of NIE inclusion in the subject without treatment, or relative to the amount of NIE inclusion in a population of similar subjects. The reduction/correction may be at least 10% less NIE inclusion relative to the average subject, or the subject prior to treatment. The reduction may be at least 20% less NIE inclusion relative to an average subject, or the subject prior to treatment. The reduction may be at least 40% less NIE inclusion relative to an average subject, or the subject prior to treatment. The reduction may be at least 50% less NIE inclusion relative to an average subject, or the subject prior to treatment. The reduction may be at least 60% less NIE inclusion relative to an average subject, or the subject prior to treatment. The reduction may be at least 80% less NIE inclusion relative to an average subject, or the subject prior to treatment. The reduction may be at least 90% less NIE inclusion relative to an average subject, or the subject prior to treatment.

Where reference is made to increasing active-SCN1A protein levels, the increase may be clinically significant. The increase may be relative to the level of active-SCN1A protein in the subject without treatment, or relative to the amount of active-SCN1A protein in a population of similar subjects. The increase may be at least 10% more active-SCN1A protein relative to the average subject, or the subject prior to treatment. The increase may be at least 20% more active-SCN1A protein relative to the average subject, or the subject prior to treatment. The increase may be at least 40% more active-SCN1A protein relative to the average subject, or the subject prior to treatment. The increase may be at least 50% more active-SCN1A protein relative to the average subject, or the subject prior to treatment. The increase may be at least 80% more active-SCN1A protein relative to the average subject, or the subject prior to treatment. The increase may be at least 100% more active-SCN1A protein relative to the average subject, or the subject prior to treatment. The increase may be at least 200% more active-SCN1A protein relative to the average subject, or the subject prior to treatment. The increase may be at least 500% more active-SCN1A protein relative to the average subject, or the subject prior to treatment.

In embodiments wherein the NIE repressor agent comprises a polynucleic acid polymer, the polynucleic acid polymer may be about 50 nucleotides in length. The polynucleic acid polymer may be about 45 nucleotides in length. The polynucleic acid polymer may be about 40 nucleotides in length. The polynucleic acid polymer may be about 35 nucleotides in length. The polynucleic acid polymer may be about 30 nucleotides in length. The polynucleic acid polymer may be about 24 nucleotides in length. The polynucleic acid polymer may be about 25 nucleotides in length. The polynucleic acid polymer may be about 20 nucleotides in length. The polynucleic acid polymer may be about 19 nucleotides in length. The polynucleic acid polymer may be about 18 nucleotides in length. The polynucleic acid polymer may be about 17 nucleotides in length. The polynucleic acid polymer may be about 16 nucleotides in length. The polynucleic acid polymer may be about 15 nucleotides in length. The polynucleic acid polymer may be about 14 nucleotides in length. The polynucleic acid polymer may be about 13 nucleotides in length. The polynucleic acid polymer may be about 12 nucleotides in length. The polynucleic acid polymer may be about 11 nucleotides in length. The polynucleic acid polymer may be about 10 nucleotides in length. The polynucleic acid polymer may be between about 10 and about 50 nucleotides in length. The polynucleic acid polymer may be between about 10 and about 45 nucleotides in length. The polynucleic acid polymer may be between about 10 and about 40 nucleotides in length. The polynucleic acid polymer may be between about 10 and about 35 nucleotides in length. The polynucleic acid polymer may be between about 10 and about 30 nucleotides in length. The polynucleic acid polymer may be between about 10 and about 25 nucleotides in length. The polynucleic acid polymer may be between about 10 and about 20 nucleotides in length. The polynucleic acid polymer may be between about 15 and about 25 nucleotides in length. The polynucleic acid polymer may be between about 15 and about 30 nucleotides in length. The polynucleic acid polymer may be between about 12 and about 30 nucleotides in length.

The sequence of the polynucleic acid polymer may be at least 50%, 55%, 60%, 65%, 70%, 75%, 80%, 85%, 90%, 91%, 92%, 93%, 94%, 95%, 96%, 97%, 98%, 99%, or 99.5% complementary to a target sequence of an mRNA transcript, e.g., a partially processed mRNA transcript. The sequence of the polynucleic acid polymer may be 100% complementary to a target sequence of a pre-mRNA transcript.

The sequence of the polynucleic acid polymer may have 4 or fewer mismatches to a target sequence of the pre-mRNA transcript. The sequence of the polynucleic acid polymer may have 3 or fewer mismatches to a target sequence of the pre-mRNA transcript. The sequence of the polynucleic acid polymer may have 2 or fewer mismatches to a target sequence of the pre-mRNA transcript. The sequence of the polynucleic acid polymer may have 1 or fewer mismatches to a target sequence of the pre-mRNA transcript. The sequence of the polynucleic acid polymer may have no mismatches to a target sequence of the pre-mRNA transcript.

The polynucleic acid polymer may specifically hybridize to a target sequence of the pre-mRNA transcript. For example, the polynucleic acid polymer may have 91%, 92%, 93%, 94%, 95%, 96%, 97%, 98%, 99%, 99.5% or 100% sequence complementarity to a target sequence of the pre-mRNA transcript. The hybridization may be under high stringent hybridization conditions.

The polynucleic acid polymer may have a sequence with at least 50%, 55%, 60%, 65%, 70%, 75%, 80%, 85%, 90%, 91%, 92%, 93%, 94%, 95%, 96%, 97%, 98%, 99%, or 99.5% sequence identity to a sequence selected from the group consisting of SEQ ID NOs: 21-67. The polynucleic acid polymer may have a sequence with 100% sequence identity to a sequence selected from the group consisting of SEQ ID NOs: 21-67. In some instances, the polynucleic acid polymer may have a sequence with at least 50%, 55%, 60%, 65%, 70%, 75%, 80%, 85%, 90%, 91%, 92%, 93%, 94%, 95%, 96%, 97%, 98%, 99%, or 99.5% sequence identity to a sequence selected from the group consisting of SEQ ID NOs: 68-114. In some cases, the polynucleic acid polymer may have a sequence with 100% sequence identity to a sequence selected from the group consisting of SEQ ID NOs: 68-114.

Where reference is made to a polynucleic acid polymer sequence, the skilled person will understand that one or more substitutions may be tolerated, optionally two substitutions may be tolerated in the sequence, such that it maintains the ability to hybridize to the target sequence; or where the substitution is in a target sequence, the ability to be recognized as the target sequence. References to sequence identity may be determined by BLAST sequence alignment using standard/default parameters. For example, the sequence may have 99% identity and still function according to the present disclosure. In other embodiments, the sequence may have 98% identity and still function according to the present disclosure. In another embodiment, the sequence may have 95% identity and still function according to the present disclosure. In another embodiment, the sequence may have 90% identity and still function according to the present disclosure.

Antisense Oligomers

Provided herein is a composition comprising an antisense oligomer that induces exon skipping by binding to a targeted portion of a SCN1A NIE containing pre-mRNA. As used herein, the terms "ASO" and "antisense oligomer" are used interchangeably and refer to an oligomer such as a polynucleotide, comprising nucleobases that hybridizes to a target nucleic acid (e.g., a SCN1A NIE containing pre-mRNA) sequence by Watson-Crick base pairing or wobble base pairing (G-U). The ASO may have exact sequence complementary to the target sequence or near complementarity (e.g., sufficient complementarity to bind the target sequence and enhancing splicing at a splice site). ASOs are designed so that they bind (hybridize) to a target nucleic acid (e.g., a targeted portion of a pre-mRNA transcript) and remain hybridized under physiological conditions. Typically, if they hybridize to a site other than the intended (targeted) nucleic acid sequence, they hybridize to a limited number of sequences that are not a target nucleic acid (to a few sites other than a target nucleic acid). Design of an ASO can take into consideration the occurrence of the nucleic acid sequence of the targeted portion of the pre-mRNA transcript or a sufficiently similar nucleic acid sequence in other locations in the genome or cellular pre-mRNA or transcriptome, such that the likelihood the ASO will bind other sites and cause "off-target" effects is limited. Any antisense oligomers known in the art, for example in PCT Application No. PCT/US2014/054151, published as WO 2015/035091, titled "Reducing Nonsense-Mediated mRNA Decay," incorporated by reference herein, can be used to practice the methods described herein.

In some embodiments, ASOs "specifically hybridize" to or are "specific" to a target nucleic acid or a targeted portion of a NIE containing pre-mRNA. Typically such hybridization occurs with a $T_m$ substantially greater than 37° C., preferably at least 50° C., and typically between 60° C. to approximately 90° C. Such hybridization preferably corresponds to stringent hybridization conditions. At a given ionic strength and pH, the $T_m$ is the temperature at which 50% of a target sequence hybridizes to a complementary oligonucleotide.

Oligomers, such as oligonucleotides, are "complementary" to one another when hybridization occurs in an anti-parallel configuration between two single-stranded polynucleotides. A double-stranded polynucleotide can be "complementary" to another polynucleotide, if hybridization can occur between one of the strands of the first polynucleotide and the second. Complementarity (the degree to which one polynucleotide is complementary with another) is quantifiable in terms of the proportion (e.g., the percentage) of bases in opposing strands that are expected to form hydrogen bonds with each other, according to generally accepted base-pairing rules. The sequence of an antisense oligomer (ASO) need not be 100% complementary to that of its target nucleic acid to hybridize. In certain embodiments, ASOs can comprise at least 70%, at least 75%, at least 80%, at least 85%, at least 90%, at least 95%, at least 96%, at least 97%, at least 98%, or at least 99% sequence complementarity to a target region within the target nucleic acid sequence to which they are targeted. For example, an ASO in which 18 of 20 nucleobases of the oligomeric compound are complementary to a target region, and would therefore specifically hybridize, would represent 90 percent complementarity. In this example, the remaining non-complementary nucleobases may be clustered together or interspersed with complementary nucleobases and need not be contiguous to each other or to complementary nucleobases. Percent complementarity of an ASO with a region of a target nucleic acid can be determined routinely using BLAST programs (basic local alignment search tools) and PowerBLAST programs known in the art (Altschul, et al., J.

Mol. Biol., 1990, 215, 403-410; Zhang and Madden, Genome Res., 1997, 7, 649-656).

An ASO need not hybridize to all nucleobases in a target sequence and the nucleobases to which it does hybridize may be contiguous or noncontiguous. ASOs may hybridize over one or more segments of a pre-mRNA transcript, such that intervening or adjacent segments are not involved in the hybridization event (e.g., a loop structure or hairpin structure may be formed). In certain embodiments, an ASO hybridizes to noncontiguous nucleobases in a target pre-mRNA transcript. For example, an ASO can hybridize to nucleobases in a pre-mRNA transcript that are separated by one or more nucleobase(s) to which the ASO does not hybridize.

The ASOs described herein comprise nucleobases that are complementary to nucleobases present in a targeted portion of a NIE containing pre-mRNA. The term ASO embodies oligonucleotides and any other oligomeric molecule that comprises nucleobases capable of hybridizing to a complementary nucleobase on a target mRNA but does not comprise a sugar moiety, such as a peptide nucleic acid (PNA). The ASOs may comprise naturally-occurring nucleotides, nucleotide analogs, modified nucleotides, or any combination of two or three of the preceding. The term "naturally occurring nucleotides" includes deoxyribonucleotides and ribonucleotides. The term "modified nucleotides" includes nucleotides with modified or substituted sugar groups and/or having a modified backbone. In some embodiments, all of the nucleotides of the ASO are modified nucleotides. Chemical modifications of ASOs or components of ASOs that are compatible with the methods and compositions described herein will be evident to one of skill in the art and can be found, for example, in U.S. Pat. No. 8,258,109 B2, U.S. Pat. No. 5,656,612, U.S. Patent Publication No. 2012/0190728, and Dias and Stein, Mol. Cancer Ther. 2002, 347-355, herein incorporated by reference in their entirety.

One or more nucleobases of an ASO may be any naturally occurring, unmodified nucleobase such as adenine, guanine, cytosine, thymine and uracil, or any synthetic or modified nucleobase that is sufficiently similar to an unmodified nucleobase such that it is capable of hydrogen bonding with a nucleobase present on a target pre-mRNA. Examples of modified nucleobases include, without limitation, hypoxanthine, xanthine, 7-methylguanine, 5, 6-dihydrouracil, 5-methylcytosine, and 5-hydroxymethoylcytosine.

The ASOs described herein also comprise a backbone structure that connects the components of an oligomer. The term "backbone structure" and "oligomer linkages" may be used interchangeably and refer to the connection between monomers of the ASO. In naturally occurring oligonucleotides, the backbone comprises a 3'-5' phosphodiester linkage connecting sugar moieties of the oligomer. The backbone structure or oligomer linkages of the ASOs described herein may include (but are not limited to) phosphorothioate, phosphorodithioate, phosphoroselenoate, phosphorodiselenoate, phosphoroanilothioate, phosphoraniladate, phosphoramidate, and the like. See, e.g., LaPlanche, et al., Nucleic Acids Res. 14:9081 (1986); Stec, et al., J. Am. Chem. Soc. 106:6077 (1984), Stein, et al., Nucleic Acids Res. 16:3209 (1988), Zon, et al., Anti-Cancer Drug Design 6:539 (1991); Zon, et al., Oligonucleotides and Analogues: A Practical Approach, pp. 87-108 (F. Eckstein, Ed., Oxford University Press, Oxford England (1991)); Stec, et al., U.S. Pat. No. 5,151,510; Uhlmann and Peyman, Chemical Reviews 90:543 (1990). In some embodiments, the backbone structure of the ASO does not contain phosphorous but rather contains peptide bonds, for example in a peptide nucleic acid (PNA), or linking groups including carbamate, amides, and linear and cyclic hydrocarbon groups. In some embodiments, the backbone modification is a phosphothioate linkage. In some embodiments, the backbone modification is a phosphoramidate linkage.

In embodiments, the stereochemistry at each of the phosphorus internucleotide linkages of the ASO backbone is random. In embodiments, the stereochemistry at each of the phosphorus internucleotide linkages of the ASO backbone is controlled and is not random. For example, U.S. Pat. App. Pub. No. 2014/0194610, "Methods for the Synthesis of Functionalized Nucleic Acids," incorporated herein by reference, describes methods for independently selecting the handedness of chirality at each phosphorous atom in a nucleic acid oligomer. In embodiments, an ASO used in the methods of the invention, including, but not limited to, any of the ASOs set forth herein in Tables 5 and 6, comprises an ASO having phosphorus internucleotide linkages that are not random. In embodiments, a composition used in the methods of the invention comprises a pure diastereomeric ASO. In embodiments, a composition used in the methods of the invention comprises an ASO that has diastereomeric purity of at least about 90%, at least about 91%, at least about 92%, at least about 93%, at least about 94%, at least about 95%, at least about 96%, at least about 97%, at least about 98%, at least about 99%, about 100%, about 90% to about 100%, about 91% to about 100%, about 92% to about 100%, about 93% to about 100%, about 94% to about 100%, about 95% to about 100%, about 96% to about 100%, about 97% to about 100%, about 98% to about 100%, or about 99% to about 100%.

In embodiments, the ASO has a nonrandom mixture of Rp and Sp configurations at its phosphorus internucleotide linkages. For example, it has been suggested that a mix of Rp and Sp is required in antisense oligonucleotides to achieve a balance between good activity and nuclease stability (Wan, et al., 2014, "Synthesis, biophysical properties and biological activity of second generation antisense oligonucleotides containing chiral phosphorothioate linkages," Nucleic Acids Research 42(22): 13456-13468, incorporated herein by reference). In embodiments, an ASO used in the methods of the invention, including, but not limited to, any of the ASOs set forth herein in SEQ ID NOs: 21-114, comprises about 5-100% Rp, at least about 5% Rp, at least about 10% Rp, at least about 15% Rp, at least about 20% Rp, at least about 25% Rp, at least about 30% Rp, at least about 35% Rp, at least about 40% Rp, at least about 45% Rp, at least about 50% Rp, at least about 55% Rp, at least about 60% Rp, at least about 65% Rp, at least about 70% Rp, at least about 75% Rp, at least about 80% Rp, at least about 85% Rp, at least about 90% Rp, or at least about 95% Rp, with the remainder Sp, or about 100% Rp. In embodiments, an ASO used in the methods of the invention, including, but not limited to, any of the ASOs set forth herein in SEQ ID NOs: 21-114, comprises about 10% to about 100% Rp, about 15% to about 100% Rp, about 20% to about 100% Rp, about 25% to about 100% Rp, about 30% to about 100% Rp, about 35% to about 100% Rp, about 40% to about 100% Rp, about 45% to about 100% Rp, about 50% to about 100% Rp, about 55% to about 100% Rp, about 60% to about 100% Rp, about 65% to about 100% Rp, about 70% to about 100% Rp, about 75% to about 100% Rp, about 80% to about 100% Rp, about 85% to about 100% Rp, about 90% to about 100% Rp, or about 95% to about 100% Rp, about 20% to about 80% Rp, about 25% to about 75% Rp, about 30% to about 70% Rp, about 40% to about 60% Rp, or about 45% to about 55% Rp, with the remainder Sp.

In embodiments, an ASO used in the methods of the invention, including, but not limited to, any of the ASOs set forth herein in SEQ ID NOs: 21-114, comprises about 5-100% Sp, at least about 5% Sp, at least about 10% Sp, at least about 15% Sp, at least about 20% Sp, at least about 25% Sp, at least about 30% Sp, at least about 35% Sp, at least about 40% Sp, at least about 45% Sp, at least about 50% Sp, at least about 55% Sp, at least about 60% Sp, at least about 65% Sp, at least about 70% Sp, at least about 75% Sp, at least about 80% Sp, at least about 85% Sp, at least about 90% Sp, or at least about 95% Sp, with the remainder Rp, or about 100% Sp. In embodiments, an ASO used in the methods of the invention, including, but not limited to, any of the ASOs set forth herein in SEQ ID NOs: 21-114, comprises about 10% to about 100% Sp, about 15% to about 100% Sp, about 20% to about 100% Sp, about 25% to about 100% Sp, about 30% to about 100% Sp, about 35% to about 100% Sp, about 40% to about 100% Sp, about 45% to about 100% Sp, about 50% to about 100% Sp, about 55% to about 100% Sp, about 60% to about 100% Sp, about 65% to about 100% Sp, about 70% to about 100% Sp, about 75% to about 100% Sp, about 80% to about 100% Sp, about 85% to about 100% Sp, about 90% to about 100% Sp, or about 95% to about 100% Sp, about 20% to about 80% Sp, about 25% to about 75% Sp, about 30% to about 70% Sp, about 40% to about 60% Sp, or about 45% to about 55% Sp, with the remainder Rp.

Any of the ASOs described herein may contain a sugar moiety that comprises ribose or deoxyribose, as present in naturally occurring nucleotides, or a modified sugar moiety or sugar analog, including a morpholine ring. Non-limiting examples of modified sugar moieties include 2' substitutions such as 2'-O-methyl (2'-O-Me), 2'-O-methoxyethyl (2'MOE), 2'-O-aminoethyl, 2'F; N3'->P5' phosphoramidate, 2'dimethylaminooxyethoxy, 2'dimethylaminoethoxyethoxy, 2'-guanidinidium, 2'-O-guanidinium ethyl, carbamate modified sugars, and bicyclic modified sugars. In some embodiments, the sugar moiety modification is selected from 2'-O-Me, 2'F, and 2'MOE. In some embodiments, the sugar moiety modification is an extra bridge bond, such as in a locked nucleic acid (LNA). In some embodiments the sugar analog contains a morpholine ring, such as phosphorodiamidate morpholino (PMO). In some embodiments, the sugar moiety comprises a ribofuransyl or 2'deoxyribofuransyl modification. In some embodiments, the sugar moiety comprises 2'4'-constrained 2'O-methyloxyethyl (cMOE) modifications. In some embodiments, the sugar moiety comprises cEt 2', 4' constrained 2'-O ethyl BNA modifications. In some embodiments, the sugar moiety comprises tricycloDNA (tcDNA) modifications. In some embodiments, the sugar moiety comprises ethylene nucleic acid (ENA) modifications. In some embodiments, the sugar moiety comprises MCE modifications. Modifications are known in the art and described in the literature, e.g., by Jarver, et al., 2014, "A Chemical View of Oligonucleotides for Exon Skipping and Related Drug Applications," Nucleic Acid Therapeutics 24(1): 37-47, incorporated by reference for this purpose herein.

In some embodiments, each monomer of the ASO is modified in the same way, for example each linkage of the backbone of the ASO comprises a phosphorothioate linkage or each ribose sugar moiety comprises a 2'O-methyl modification. Such modifications that are present on each of the monomer components of an ASO are referred to as "uniform modifications." In some examples, a combination of different modifications may be desired, for example, an ASO may comprise a combination of phosphorodiamidate linkages and sugar moieties comprising morpholine rings (morpholinos). Combinations of different modifications to an ASO are referred to as "mixed modifications" or "mixed chemistries."

In some embodiments, the ASO comprises one or more backbone modifications. In some embodiments, the ASO comprises one or more sugar moiety modification. In some embodiments, the ASO comprises one or more backbone modifications and one or more sugar moiety modifications. In some embodiments, the ASO comprises a 2'MOE modification and a phosphorothioate backbone. In some embodiments, the ASO comprises a phosphorodiamidate morpholino (PMO). In some embodiments, the ASO comprises a peptide nucleic acid (PNA). Any of the ASOs or any component of an ASO (e.g., a nucleobase, sugar moiety, backbone) described herein may be modified in order to achieve desired properties or activities of the ASO or reduce undesired properties or activities of the ASO. For example, an ASO or one or more components of any ASO may be modified to enhance binding affinity to a target sequence on a pre-mRNA transcript; reduce binding to any non-target sequence; reduce degradation by cellular nucleases (i.e., RNase H); improve uptake of the ASO into a cell and/or into the nucleus of a cell; alter the pharmacokinetics or pharmacodynamics of the ASO; and/or modulate the half-life of the ASO.

In some embodiments, the ASOs are comprised of 2'-O-(2-methoxyethyl) (MOE) phosphorothioate-modified nucleotides. ASOs comprised of such nucleotides are especially well-suited to the methods disclosed herein; oligomers having such modifications have been shown to have significantly enhanced resistance to nuclease degradation and increased bioavailability, making them suitable, for example, for oral delivery in some embodiments described herein. See e.g., Geary, et al., J Pharmacol Exp Ther. 2001; 296(3):890-7; Geary, et al., J Pharmacol Exp Ther. 2001; 296(3):898-904.

Methods of synthesizing ASOs will be known to one of skill in the art. Alternatively or in addition, ASOs may be obtained from a commercial source.

Unless specified otherwise, the left-hand end of single-stranded nucleic acid (e.g., pre-mRNA transcript, oligonucleotide, ASO, etc.) sequences is the 5' end and the left-hand direction of single or double-stranded nucleic acid sequences is referred to as the 5' direction. Similarly, the right-hand end or direction of a nucleic acid sequence (single or double stranded) is the 3' end or direction. Generally, a region or sequence that is 5' to a reference point in a nucleic acid is referred to as "upstream," and a region or sequence that is 3' to a reference point in a nucleic acid is referred to as "downstream." Generally, the 5' direction or end of an mRNA is where the initiation or start codon is located, while the 3' end or direction is where the termination codon is located. In some aspects, nucleotides that are upstream of a reference point in a nucleic acid may be designated by a negative number, while nucleotides that are downstream of a reference point may be designated by a positive number. For example, a reference point (e.g., an exon-exon junction in mRNA) may be designated as the "zero" site, and a nucleotide that is directly adjacent and upstream of the reference point is designated "minus one," e.g., "4," while a nucleotide that is directly adjacent and downstream of the reference point is designated "plus one," e.g., "+1."

In some embodiments, the ASOs are complementary to (and bind to) a targeted portion of a SCN1A NIE containing pre-mRNA that is downstream (in the 3' direction) of the 5' splice site (or 3' end of the NIE) of the included exon in a SCN1A NIE containing pre-mRNA (e.g., the direction designated by positive numbers relative to the 5' splice site). In some embodiments, the ASOs are complementary to a targeted portion of the SCN1A NIE containing pre-mRNA that is within the region about +1 to about +500 relative to the 5' splice site (or 3' end) of the included exon. In some embodiments, the ASOs may be complementary to a targeted portion of a SCN1A NIE containing pre-mRNA that is within the region between nucleotides +6 and +496 relative to the 5' splice site (or 3' end) of the included exon. In some aspects, the ASOs are complementary to a targeted portion that is within the region about +1 to about +500, about +1 to about +490, about +1 to about +480, about +1 to about +470, about +1 to about +460, about +1 to about +450, about +1 to about +440, about +1 to about +430, about +1 to about +420, about +1 to about +410, about +1 to about +400, about +1 to about +390, about +1 to about +380, about +1 to about +370, about +1 to about +360, about +1 to about +350, about +1 to about +340, about +1 to about +330, about +1 to about +320, about +1 to about +310, about +1 to about +300, about +1 to about +290, about +1 to about +280, about +1 to about +270, about +1 to about +260, about +1 to about +250, about +1 to about +240, about +1 to about +230, about +1 to about +220, about +1 to about +210, about +1 to about +200, about +1 to about +190, about +1 to about +180, about +1 to about +170, about +1 to about +160, about +1 to about +150, about +1 to about +140, about +1 to about +130, about +1 to about +120, about +1 to about +110, about +1 to about +100, about +1 to about +90, about +1 to about +80, about +1 to about +70, about +1 to about +60, about +1 to about +50, about +1 to about +40, about +1 to about +30, or about +1 to about +20 relative to 5' splice site (or 3' end) of the included exon. In some aspects, the ASOs are complementary to a targeted portion that is within the region from about +1 to about +100, from about +100 to about +200, from about +200 to about +300, from about +300 to about +400, or from about +400 to about +500 relative to 5' splice site (or 3' end) of the included exon.

In some embodiments, the ASOs are complementary to (and bind to) a targeted portion of a SCN1A NIE containing pre-mRNA that is upstream (in the 5' direction) of the 5' splice site (or 3' end) of the included exon in a SCN1A NIE containing pre-mRNA (e.g., the direction designated by negative numbers relative to the 5' splice site). In some embodiments, the ASOs are complementary to a targeted portion of the SCN1A NIE containing pre-mRNA that is within the region about −4 to about −270 relative to the 5' splice site (or 3'end) of the included exon. In some embodiments, the ASOs may be complementary to a targeted portion of a SCN1A NIE containing pre-mRNA that is within the region between nucleotides −1 and −264 relative to the 5' splice site (or 3' end) of the included exon. In some aspects, the ASOs are complementary to a targeted portion that is within the region about −1 to about −270, about −1 to about −260, about −1 to about −250, about −1 to about −240, about −1 to about −230, about −1 to about −220, about −1 to about −210, about −1 to about −200, about −1 to about −190, about −1 to about −180, about −1 to about −170, about −1 to about −160, about −1 to about −150, about −1 to about −140, about −1 to about −130, about −1 to about −120, about −1 to about −110, about −1 to about −100, about −1 to about −90, about −1 to about −80, about −1 to about −70, about −1 to about −60, about −1 to about −50, about −1 to about −40, about −1 to about −30, or about −1 to about −20 relative to 5' splice site (or 3' end) of the included exon. In some aspects, the ASOs are complementary to a targeted portion that is within the region from about −1 to about −50, from about −50 to about −100, from about −100 to about −150, from about −150 to about −200, or from about −200 to about −250 relative to 5' splice site (or 3' end) of the included exon.

In some embodiments, the ASOs are complementary to a targeted region of a SCN1A NIE containing pre-mRNA that is upstream (in the 5' direction) of the 3' splice site (or 5' end) of the included exon in a SCN1A NIE containing pre-mRNA (e.g., in the direction designated by negative numbers). In some embodiments, the ASOs are complementary to a targeted portion of the SCN1A NIE containing pre-mRNA that is within the region about −1 to about −500 relative to the 3' splice site (or 5' end) of the included exon. In some embodiments, the ASOs are complementary to a targeted portion of the SCN1A NIE containing pre-mRNA that is within the region −1 to −496 relative to the 3' splice site of the included exon. In some aspects, the ASOs are complementary to a targeted portion that is within the region about −1 to about −500, about −1 to about −490, about −1 to about −480, about −1 to about −470, about −1 to about −460, about −1 to about −450, about −1 to about −440, about −1 to about −430, about −1 to about −420, about −1 to about −410, about −1 to about −400, about −1 to about −390, about −1 to about −380, about −1 to about −370, about −1 to about −360, about −1 to about −350, about −1 to about −340, about −1 to about −330, about −1 to about −320, about −1 to about −310, about −1 to about −300, about −1 to about −290, about −1 to about −280, about −1 to about −270, about −1 to about −260, about −1 to about −250, about −1 to about −240, about −1 to about −230, about −1 to about −220, about −1 to about −210, about −1 to about −200, about −1 to about −190, about −1 to about −180, about −1 to about −170, about −1 to about −160, about −1 to about −150, about −1 to about −140, about −1 to about −130, about −1 to about −120, about −1 to about −110, about −1 to about −100, about −1 to about −90, about −1 to about −80, about −1 to about −70, about −1 to about −60, about −1 to about −50, about −1 to about −40, or about −1 to about −30 relative to 3' splice site of the included exon. In some aspects, the ASOs are complementary to a targeted portion that is within the region from about −1 to about −100, from about −100 to about −200, from about −200 to about −300, from about −300 to about −400, or from about −400 to about −500 relative to 3' splice site of the included exon.

In some embodiments, the ASOs are complementary to a targeted region of a SCN1A NIE containing pre-mRNA that is downstream (in the 3' direction) of the 3' splice site (5' end) of the included exon in a SCN1A NIE containing pre-mRNA (e.g., in the direction designated by positive numbers). In some embodiments, the ASOs are complementary to a targeted portion of the SCN1A NIE containing pre-mRNA that is within the region of about +1 to about +100 relative to the 3' splice site of the included exon. In some aspects, the ASOs are complementary to a targeted portion that is within the region about +1 to about +90, about +1 to about +80, about +1 to about +70, about +1 to about +60, about +1 to about +50, about +1 to about +40, about +1 to about +30, about +1 to about +20, or about +1 to about +10 relative to 3' splice site of the included exon.

In some embodiments, the targeted portion of the SCN1A NIE containing pre-mRNA is within the region +100 relative to the 5' splice site (3' end) of the included exon to −100 relative to the 3' splice site (5' end) of the included exon. In some embodiments, the targeted portion of the SCN1A NIE containing pre-mRNA is within the NIE. In some embodiments, the targeted portion of the SCN1A NIE containing pre-mRNA comprises a pseudo-exon and intron boundary.

The ASOs may be of any length suitable for specific binding and effective enhancement of splicing. In some embodiments, the ASOs consist of 8 to 50 nucleobases. For example, the ASO may be 8, 9, 10, 11, 12, 13, 14, 15, 16, 17, 18, 19, 20, 21, 22, 23, 24, 25, 26, 27, 28, 29, 30, 31, 32, 33, 34, 35, 40, 45, or 50 nucleobases in length. In some embodiments, the ASOs consist of more than 50 nucleobases. In some embodiments, the ASO is from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, 12 to 15 nucleobases, 13 to 50 nucleobases, 13 to 40 nucleobases, 13 to 35 nucleobases, 13 to 30 nucleobases, 13 to 25 nucleobases, 13 to 20 nucleobases, 14 to 50 nucleobases, 14 to 40 nucleobases, 14 to 35 nucleobases, 14 to 30 nucleobases, 14 to 25 nucleobases, 14 to 20 nucleobases, 15 to 50 nucleobases, 15 to 40 nucleobases, 15 to 35 nucleobases, 15 to 30 nucleobases, 15 to 25 nucleobases, 15 to 20 nucleobases, 20 to 50 nucleobases, 20 to 40 nucleobases, 20 to 35 nucleobases, 20 to 30 nucleobases, 20 to 25 nucleobases, 25 to 50 nucleobases, 25 to 40 nucleobases, 25 to 35 nucleobases, or 25 to 30 nucleobases in length. In some embodiments, the ASOs are 18 nucleotides in length. In some embodiments, the ASOs are 15 nucleotides in length. In some embodiments, the ASOs are 25 nucleotides in length.

In some embodiments, two or more ASOs with different chemistries but complementary to the same targeted portion of the NIE containing pre-mRNA are used. In some embodiments, two or more ASOs that are complementary to different targeted portions of the NIE containing pre-mRNA are used.

In embodiments, the antisense oligonucleotides of the invention are chemically linked to one or more moieties or conjugates, e.g., a targeting moiety or other conjugate that enhances the activity or cellular uptake of the oligonucleotide. Such moieties include, but are not limited to, a lipid moiety, e.g., as a cholesterol moiety, a cholesteryl moiety, an aliphatic chain, e.g., dodecandiol or undecyl residues, a polyamine or a polyethylene glycol chain, or adamantane acetic acid. Oligonucleotides comprising lipophilic moieties and preparation methods have been described in the published literature. In embodiments, the antisense oligonucleotide is conjugated with a moiety including, but not limited to, an abasic nucleotide, a polyether, a polyamine, a polyamide, a peptides, a carbohydrate, e.g., N-acetylgalactosamine (GalNAc), N-Ac-Glucosamine (GluNAc), or mannose (e.g., mannose-6-phosphate), a lipid, or a polyhydrocarbon compound. Conjugates can be linked to one or more of any nucleotides comprising the antisense oligonucleotide at any of several positions on the sugar, base or phosphate group, as understood in the art and described in the literature, e.g., using a linker. Linkers can include a bivalent or trivalent branched linker. In embodiments, the conjugate is attached to the 3' end of the antisense oligonucleotide. Methods of preparing oligonucleotide conjugates are described, e.g., in U.S. Pat. No. 8,450,467, "Carbohydrate conjugates as delivery agents for oligonucleotides," incorporated by reference herein.

In some embodiments, the nucleic acid to be targeted by an ASO is a SCN1A NIE containing pre-mRNA expressed in a cell, such as a eukaryotic cell. In some embodiments, the term "cell" may refer to a population of cells. In some embodiments, the cell is in a subject. In some embodiments, the cell is isolated from a subject. In some embodiments, the cell is ex vivo. In some embodiments, the cell is a condition or disease-relevant cell or a cell line. In some embodiments, the cell is in vitro (e.g., in cell culture).

Pharmaceutical Compositions

Pharmaceutical compositions or formulations comprising the agent, e.g., antisense oligonucleotide, of the described compositions and for use in any of the described methods can be prepared according to conventional techniques well known in the pharmaceutical industry and described in the published literature. In embodiments, a pharmaceutical composition or formulation for treating a subject comprises an effective amount of any antisense oligomer as described herein, or a pharmaceutically acceptable salt, solvate, hydrate or ester thereof. The pharmaceutical formulation comprising an antisense oligomer may further comprise a pharmaceutically acceptable excipient, diluent or carrier.

Pharmaceutically acceptable salts are suitable for use in contact with the tissues of humans and lower animals without undue toxicity, irritation, allergic response, etc., and are commensurate with a reasonable benefit/risk ratio. (See, e.g., S. M. Berge, et al., J. Pharmaceutical Sciences, 66: 1-19 (1977), incorporated herein by reference for this purpose. The salts can be prepared in situ during the final isolation and purification of the compounds, or separately by reacting the free base function with a suitable organic acid. Examples of pharmaceutically acceptable, nontoxic acid addition salts are salts of an amino group formed with inorganic acids such as hydrochloric acid, hydrobromic acid, phosphoric acid, sulfuric acid and perchloric acid or with organic acids such as acetic acid, oxalic acid, maleic acid, tartaric acid, citric acid, succinic acid or malonic acid or by using other documented methodologies such as ion exchange. Other pharmaceutically acceptable salts include adipate, alginate, ascorbate, aspartate, benzenesulfonate, benzoate, bisulfate, borate, butyrate, camphorate, camphorsulfonate, citrate, cyclopentanepropionate, digluconate, dodecylsulfate, ethanesulfonate, formate, fumarate, glucoheptonate, glycerophosphate, gluconate, hemisulfate, heptanoate, hexanoate, hydroiodide, 2-hydroxy-ethanesulfonate, lactobionate, lactate, laurate, lauryl sulfate, malate, maleate, malonate, methanesulfonate, 2-naphthalenesulfonate, nicotinate, nitrate, oleate, oxalate, palmitate, pamoate, pectinate, persulfate, 3-phenylpropionate, phosphate, picrate, pivalate, propionate, stearate, succinate, sulfate, tartrate, thiocyanate, p-toluenesulfonate, undecanoate, valerate salts, and the like. Representative alkali or alkaline earth metal salts include sodium, lithium, potassium, calcium, magnesium, and the like. Further pharmaceutically acceptable salts include, when appropriate, nontoxic ammonium, quaternary ammonium, and amine cations formed using counterions such as halide, hydroxide, carboxylate, sulfate, phosphate, nitrate, lower alkyl sulfonate and aryl sulfonate.

In embodiments, the compositions are formulated into any of many possible dosage forms such as, but not limited to, tablets, capsules, gel capsules, liquid syrups, soft gels, suppositories, and enemas. In embodiments, the compositions are formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers. In embodiments, a pharmaceutical formulation or composition of the present invention includes, but is not limited to, a solution, emulsion, microemulsion, foam or liposome-containing formulation (e.g., cationic or noncationic liposomes).

The pharmaceutical composition or formulation described herein may comprise one or more penetration enhancers, carriers, excipients or other active or inactive ingredients as appropriate and well known to those of skill in the art or described in the published literature. In embodiments, liposomes also include sterically stabilized liposomes, e.g., liposomes comprising one or more specialized lipids. These specialized lipids result in liposomes with enhanced circulation lifetimes. In embodiments, a sterically stabilized liposome comprises one or more glycolipids or is derivatized with one or more hydrophilic polymers, such as a polyethylene glycol (PEG) moiety. In embodiments, a surfactant is included in the pharmaceutical formulation or compositions. The use of surfactants in drug products, formulations and emulsions is well known in the art. In embodiments, the present invention employs a penetration enhancer to effect the efficient delivery of the antisense oligonucleotide, e.g., to aid diffusion across cell membranes and/or enhance the permeability of a lipophilic drug. In embodiments, the penetration enhancers are a surfactant, fatty acid, bile salt, chelating agent, or non-chelating non-surfactant.

In embodiments, the pharmaceutical formulation comprises multiple antisense oligonucleotides. In embodiments, the antisense oligonucleotide is administered in combination with another drug or therapeutic agent.

Combination Therapies

In some embodiments, the ASOs disclosed in the present disclosure can be used in combination with one or more additional therapeutic agents. In some embodiments, the one or more additional therapeutic agents can comprise a small molecule. For example, the one or more additional therapeutic agents can comprise a small molecule described in WO2016128343A1, WO2017053982A1, WO2016196386A1, WO201428459A1, WO201524876A2, WO2013119916A2, and WO2014209841A2, which are incorporated by reference herein in their entirety. In some embodiments, the one or more additional therapeutic agents comprise an ASO that can be used to correct intron retention. In some embodiments, the one or more other agents are selected from the ASOs listed in Table 1a or Table 1b.

TABLE 1a

Exemplary ASOs to correct intron retention

| SEQ ID NO: | Name | Sequence (5'-3') | Retained Intron |
|---|---|---|---|
| 115 | SCN1A-IVS21+6 | CAGAGAAAAUAGUGUUCA | 21 |
| 116 | SCN1A-IVS21+11 | AUAUUCAGAGAAAAUAGU | 21 |
| 117 | SCN1A-IVS21+16 | UAAAAAUAUUCAGAGAAA | 21 |
| 118 | SCN1A-IVS21+21 | AACAAUAAAAAUAUUCAG | 21 |
| 119 | SCN1A-IVS21+26 | UUCCAAACAAUAAAAAUA | 21 |
| 120 | SCN1A-IVS21+31 | UAUUAUUCCAAACAAUAA | 21 |
| 121 | SCN1A-IVS21+36 | UUUGUUAUAUUCCAAAC | 21 |

TABLE 1a-continued

Exemplary ASOs to correct intron retention

| SEQ ID NO: | Name | Sequence (5'-3') | Retained Intron |
|---|---|---|---|
| 122 | SCN1A-IVS21+41 | AUUAUUUUGUUAUUAUUC | 21 |
| 123 | SCN1A-IVS21+46 | AUGUCAUUAUUUUGUUAU | 21 |
| 124 | SCN1A-IVS21+51 | GAUGUAUGUCAUUAUUUU | 21 |
| 125 | SCN1A-IVS21+56 | UAAUAGAUGUAUGUCAUU | 21 |
| 126 | SCN1A-IVS21+61 | CUAAAUAAUAGAUGUAUG | 21 |
| 127 | SCN1A-IVS21+66 | AGGAACUAAAUAAUAGAU | 21 |
| 128 | SCN1A-IVS21+71 | UUCUUAGGAACUAAAUAA | 21 |
| 129 | SCN1A-IVS21+76 | ACUUUUUCUUAGGAACUA | 21 |
| 130 | SCN1A-IVS21+81 | UAUAUACUUUUUCUUAGG | 21 |
| 131 | SCN1A-IVS21-16 | UGCAUGUUUUACUUUGGA | 21 |
| 132 | SCN1A-IVS21-21 | GUUUUACUUUGGAGUAAA | 21 |
| 133 | SCN1A-IVS21-26 | ACUUUGGAGUAAAAAUAA | 21 |
| 134 | SCN1A-IVS21-31 | GGAGUAAAAAUAAUUUAG | 21 |
| 135 | SCN1A-IVS21-36 | AAAAAUAAUUUAGACCUG | 21 |
| 136 | SCN1A-IVS21-41 | UAAUUUAGACCUGAUGUU | 21 |
| 137 | SCN1A-IVS21-46 | UAGACCUGAUGUUUAAUA | 21 |
| 138 | SCN1A-IVS21-51 | CUGAUGUUUAAUAAAUAU | 21 |
| 139 | SCN1A-IVS21-56 | GUUUAAUAAAUAUUCUUA | 21 |
| 140 | SCN1A-IVS21-61 | AUAAAUAUUCUUACUGAU | 21 |
| 141 | SCN1A-IVS21-66 | UAUUCUUACUGAUAUAAU | 21 |
| 142 | SCN1A-IVS21-71 | UUACUGAUAUAAUUUUCA | 21 |
| 143 | SCN1A-IVS21-76 | GAUAUAAUUUUCAAAAGG | 21 |
| 144 | SCN1A-IVS21-81 | AAUUUUCAAAAGGGAAUA | 21 |
| 145 | SCN1A-IVS21-27 | CUUUGGAGUAAAAAUAAU | 21 |
| 146 | SCN1A-IVS21-28 | UUUGGAGUAAAAAUAAUU | 21 |
| 148 | SCN1A-IVS21-29 | UUGGAGUAAAAAUAAUUU | 21 |
| 149 | SCN1A-IVS21-30 | UGGAGUAAAAAUAAUUUA | 21 |
| 150 | SCN1A-IVS21-32 | GAGUAAAAAUAAUUUAGA | 21 |
| 151 | SCN1A-IVS21-33 | AGUAAAAAUAAUUUAGAC | 21 |
| 152 | SCN1A-IVS21-34 | GUAAAAAUAAUUUAGACC | 21 |
| 153 | SCN1A-IVS21-35 | UAAAAAUAAUUUAGACCU | 21 |
| 154 | SCN1A-IVS21-72 | UACUGAUAUAAUUUUCAA | 21 |
| 155 | SCN1A-IVS21-73 | ACUGAUAUAAUUUUCAAA | 21 |
| 156 | SCN1A-IVS21-74 | CUGAUAUAAUUUUCAAAA | 21 |
| 157 | SCN1A-IVS21-75 | UGAUAUAAUUUUCAAAAG | 21 |
| 158 | SCN1A-IVS21-77 | AUAUAAUUUUCAAAAGGG | 21 |
| 159 | SCN1A-IVS21-78 | UAUAAUUUUCAAAAGGGA | 21 |
| 160 | SCN1A-IVS21-79 | AUAAUUUUCAAAAGGGAA | 21 |

TABLE 1a-continued

Exemplary ASOs to correct intron retention

| SEQ ID NO: | Name | Sequence (5'-3') | Retained Intron |
|---|---|---|---|
| 161 | SCN1A-IVS21-80 | UAAUUUUCAAAAGGGAAU | 21 |
| 162 | | CAAGGAUUAAAGGUAGCA | 21 |

TABLE 1b

Exemplary ASOs to correct intron retention

| SEQ ID NO: | Name | SeqTence (5'-3') | Retained Intron |
|---|---|---|---|
| 163 | SCN1A-IVS21+6 | CAGAGAAAATAGTGTTCA | 21 |
| 164 | SCN1A-IVS21+11 | ATATTCAGAGAAAATAGT | 21 |
| 165 | SCN1A-IVS21+16 | TAAAAATATTCAGAGAAA | 21 |
| 166 | SCN1A-IVS21+21 | AACAATAAAAATATTCAG | 21 |
| 167 | SCN1A-IVS21+26 | TTCCAAACAATAAAAATA | 21 |
| 168 | SCN1A-IVS21+31 | TATTATTCCAAACAATAA | 21 |
| 169 | SCN1A-IVS21+36 | TTTGTTATTATTCCAAAC | 21 |
| 170 | SCN1A-IVS21+41 | ATTATTTTGTTATTATTC | 21 |
| 171 | SCN1A-IVS21+46 | ATGTCATTATTTTGTTAT | 21 |
| 172 | SCN1A-IVS21+51 | GATGTATGTCATTATTTT | 21 |
| 173 | SCN1A-IVS21+56 | TAATAGATGTATGTCATT | 21 |
| 174 | SCN1A-IVS21+61 | CTAAATAATAGATGTATG | 21 |
| 175 | SCN1A-IVS21+66 | AGGAACTAAATAATAGAT | 21 |
| 176 | SCN1A-IVS21+71 | TTCTTAGGAACTAAATAA | 21 |
| 177 | SCN1A-IVS21+76 | ACTTTTCTTAGGAACTA | 21 |
| 178 | SCN1A-IVS21+81 | TATATACTTTTCTTAGG | 21 |
| 179 | SCN1A-IVS21-16 | TGCATGTTTTACTTTGGA | 21 |
| 180 | SCN1A-IVS21-21 | GTTTTACTTTGGAGTAAA | 21 |
| 181 | SCN1A-IVS21-26 | ACTTTGGAGTAAAAATAA | 21 |
| 182 | SCN1A-IVS21-31 | GGAGTAAAAATAATTTAG | 21 |
| 183 | SCN1A-IVS21-36 | AAAAATAATTTAGACCTG | 21 |
| 184 | SCN1A-IVS21-41 | TAATTTAGACCTGATGTT | 21 |
| 185 | SCN1A-IVS21-46 | TAGACCTGATGTTTAATA | 21 |
| 186 | SCN1A-IVS21-51 | CTGATGTTTAATAAATAT | 21 |
| 187 | SCN1A-IVS21-56 | GTTTAATAAATATTCTTA | 21 |
| 188 | SCN1A-IVS21-61 | ATAAATATTCTTACTGAT | 21 |
| 189 | SCN1A-IVS21-66 | TATTCTTACTGATATAAT | 21 |
| 190 | SCN1A-IVS21-71 | TTACTGATATAATTTTCA | 21 |
| 191 | SCN1A-IVS21-76 | GATATAATTTTCAAAAGG | 21 |
| 192 | SCN1A-IVS21-81 | AATTTTCAAAAGGGAATA | 21 |
| 193 | SCN1A-IVS21-27 | CTTTGGAGTAAAAATAAT | 21 |
| 194 | SCN1A-IVS21-28 | TTTGGAGTAAAAATAATT | 21 |
| 195 | SCN1A-IVS21-29 | TTGGAGTAAAAATAATTT | 21 |
| 196 | SCN1A-IVS21-30 | TGGAGTAAAAATAATTTA | 21 |
| 197 | SCN1A-IVS21-32 | GAGTAAAAATAATTTAGA | 21 |
| 198 | SCN1A-IVS21-33 | AGTAAAAATAATTTAGAC | 21 |
| 199 | SCN1A-IVS21-34 | GTAAAAATAATTTAGACC | 21 |
| 200 | SCN1A-IVS21-35 | TAAAAATAATTTAGACCT | 21 |
| 201 | SCN1A-IVS21-72 | TACTGATATAATTTTCAA | 21 |
| 202 | SCN1A-IVS21-73 | ACTGATATAATTTTCAAA | 21 |
| 203 | SCN1A-IVS21-74 | CTGATATAATTTTCAAAA | 21 |
| 204 | SCN1A-IVS21-75 | TGATATAATTTTCAAAAG | 21 |
| 205 | SCN1A-IVS21-77 | ATATAATTTTCAAAAGGG | 21 |
| 206 | SCN1A-IVS21-78 | TATAATTTTCAAAAGGGA | 21 |
| 207 | SCN1A-IVS21-79 | ATAATTTTCAAAAGGGAA | 21 |
| 208 | SCN1A-IVS21-80 | TAATTTTCAAAAGGGAAT | 21 |
| 209 | | CAAGGATTAAAGGTAGCA | 21 |

Treatment of Subjects

Any of the compositions provided herein may be administered to an individual. "Individual" may be used interchangeably with "subject" or "patient." An individual may be a mammal, for example a human or animal such as a non-human primate, a rodent, a rabbit, a rat, a mouse, a horse, a donkey, a goat, a cat, a dog, a cow, a pig, or a sheep. In embodiments, the individual is a human. In embodiments, the individual is a fetus, an embryo, or a child. In other embodiments, the individual may be another eukaryotic organism, such as a plant. In some embodiments, the compositions provided herein are administered to a cell ex vivo.

In some embodiments, the compositions provided herein are administered to an individual as a method of treating a disease or disorder. In some embodiments, the individual has a genetic disease, such as any of the diseases described herein. In some embodiments, the individual is at risk of having a disease, such as any of the diseases described herein. In some embodiments, the individual is at increased risk of having a disease or disorder caused by insufficient amount of a protein or insufficient activity of a protein. If an individual is "at an increased risk" of having a disease or disorder caused insufficient amount of a protein or insufficient activity of a protein, the method involves preventative or prophylactic treatment. For example, an individual may be at an increased risk of having such a disease or disorder because of family history of the disease. Typically, individuals at an increased risk of having such a disease or disorder benefit from prophylactic treatment (e.g., by preventing or delaying the onset or progression of the disease or disorder).

In embodiments, a fetus is treated in utero, e.g., by administering the ASO composition to the fetus directly or indirectly (e.g., via the mother).

Suitable routes for administration of ASOs of the present invention may vary depending on cell type to which delivery of the ASOs is desired. Multiple tissues and organs are affected by Dravet syndrome; Epilepsy, generalized, with febrile seizures plus, type 2; Febrile seizures, familial, 3A; Migraine, familial hemiplegic, 3; Autism; Epileptic encephalopathy, early infantile, 13; Sick sinus syndrome 1; Alzheimer's disease or SUDEP, with the brain being the most significantly affected tissue. The ASOs of the present invention may be administered to patients parenterally, for example, by intrathecal injection, intracerebroventricular injection, intraperitoneal injection, intramuscular injection, subcutaneous injection, intravitreal injection, or intravenous injection.

In some embodiments, the disease or condition is induced by a mutation in $Na_v1.1$ (a protein encoded by the SCN1A gene). In some instances, the mutation is a loss-of-function mutation in $Na_v1.1$. In some cases, the loss-of-function mutation in $Na_v1.1$ comprises one or more mutations that decreases or impairs the function of $Na_v1.1$ (e.g., by 10%, 20%, 30%, 40%, 50%, 60%, 70%, 80%, 90%, 95%, or more) relative to the function of a wild-type $Na_v1.1$. In some cases, the loss-of-function mutation in $Na_v1.1$ comprises one or more mutations that result in a disease phenotype. Exemplary loss-of-function mutations include, but are not limited to, R859C, T875M, V1353L, I1656M, R1657C, A1685V, M1841T, and R1916G.

In other instances, the mutation is a gain-of-function mutation in Nav1.1. In such cases, the gain-of-function mutation comprises one or more mutations that prolongs activation of $Na_v1.1$ (e.g., by 10%, 20%, 30%, 40%, 50%, 60%, 70%, 80%, 90%, 95%, or more) relative to the function of a wild-type $Na_v1.1$. In such cases, the gain-of-function mutation in $Na_v1.1$ comprises one or more mutations that result in a disease phenotype. Exemplary gain-of-function mutations include, but are not limited to, D188V, W1204R, R1648H, and D1866Y.

In some embodiments, the disease or condition is an encephalopathy. In some cases, the encephalopathy is induced by a loss-of-function mutation in Nav1.1.

In some embodiments, the encephalopathy is epileptic encephalopathy. Exemplary epileptic encephalopathies include, but are not limited to, Dravet Syndrome (DS) (also known as severe myoclonic epilepsy of infancy or SMEI); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); early infantile SCN1A encephalopathy; early infantile epileptic encephalopathy (EIEE); or sick sinus syndrome 1. In some embodiments, the disease or condition is epileptic encephalopathy, optionally selected from Dravet Syndrome (DS) (also known as severe myoclonic epilepsy of infancy or SMEI); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); and sick sinus syndrome 1.

In some instances, GEFS+ is epilepsy, generalized, with febrile seizures plus, type 2.

In some instances, the Febrile seizure is Febrile seizures, familial, 3A.

In some instances, SMEB is SMEB without generalized spike wave (SMEB-SW), SMEB without myoclonic seizures (SMEB-M), SMEB lacking more than one feature of SMEI (SMEB-O), or intractable childhood epilepsy with generalized tonic-clonic seizures (ICEGTC).

In some embodiments, the diseases or conditions induced by a loss-of-function mutation in $Na_v1.1$ include, but are not limited to, Dravet Syndrome (DS) (also known as SMEI); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); sick sinus syndrome 1; early infantile SCN1A encephalopathy; early infantile epileptic encephalopathy (EIEE); autism; or malignant migrating partial seizures of infancy.

In some embodiments, the disease or condition is induced by a gain-of-function mutation in $Na_v1.1$. Exemplary diseases or conditions associated with a gain-of-function mutation in $Na_v1.1$ include, but are not limited to, migraine. In some instances, the disease or condition induced by a gain-of-function mutation in $Na_v1.1$ is migraine.

In some instances, the migraine is migraine, familial hemiplegic, 3.

In some embodiments, the disease or condition is a $Na_v1.1$ genetic epilepsy. The Nav1.1 genetic epilepsy can include a loss-of-function mutation in $Na_v1.1$ or a gain-of-function mutation in $Na_v1.1$. In some cases, the $Na_v1.1$ genetic epilepsy includes one or more hereditary mutations. In other cases, the $Na_v1.1$ genetic epilepsy includes one or more de novo mutations. In some cases, the $Na_v1.1$ genetic epilepsy includes Dravet Syndrome (DS) (also known as severe myoclonic epilepsy of infancy or SMEI); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; early infantile SCN1A encephalopathy; early infantile epileptic encephalopathy (EIEE); sudden unexpected death in epilepsy (SUDEP); or malignant migrating partial seizures of infancy. In some cases, the $Na_v1.1$ genetic epilepsy associated with a loss-of-function mutation in $Na_v1.1$ includes Dravet Syndrome (DS) (also known as severe myoclonic epilepsy of infancy or SMEI); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; early infantile SCN1A encephalopathy; early infantile epileptic encephalopathy (EIEE); sudden unexpected death in epilepsy (SUDEP); malignant migrating partial seizures of infancy.

In some embodiments, the disease or condition is associated with a haploinsufficiency of the SCN1A gene. Exemplary diseases or conditions associated with a haploinsufficiency of the SCN1A gene include, but are not limited to, Dravet Syndrome (DS) (also known as SMEI); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); sick sinus syndrome 1; early infantile SCN1A encephalopathy; early infantile epileptic encephalopathy (EIEE); or malignant migrating partial seizures of infancy. In some cases, the disease or condition is Dravet Syndrome (DS) (also known as SMEI); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); sick sinus syndrome 1; early infantile SCN1A encephalopathy; early infantile epileptic encephalopathy (EIEE); or malignant migrating partial seizures of infancy.

In some cases, the disease or condition is Dravet Syndrome (DS).

Dravet syndrome (DS), otherwise known as severe myoclonic epilepsy of infancy (SMEI), is an epileptic encephalopathy presenting in the first year of life. Dravet syndrome is an increasingly recognized epileptic encephalopathy in which the clinical diagnosis is supported by the finding of sodium channel gene mutations in approximately 70-80% of patients. Mutations of ion channel genes play a major role in the pathogenesis of a range of epilepsy syndromes, resulting in some epilepsies being regarded as channelopathies. Voltage-gated sodium channels (VGSCs) play an essential role in neuronal excitability; therefore, it is not surprising that many mutations associated with DS have been identified in the gene encoding a VGSC subunit. The disease is described by, e.g., Mulley, et al., 2005, and the disease description at OMIM #607208 (Online Mendelian Inheritance in Man, Johns Hopkins University, 1966-2015), both incorporated by reference herein.

Between 70% and 80% of patients carry sodium channel al subunit gene (SCN1A) abnormalities, and truncating mutations account for about 40%, and have a significant correlation with an earlier age of seizures onset. Sequencing mutations are found in about 70% of cases and comprise truncating (40%) and missense mutations (40%) with the remaining being splice-site changes. Most mutations are de novo, but familial mutations occur in 5-10% of cases and are usually missense in nature. The remaining SCN1A mutations comprise splice-site and missense mutations, most of which fall into the pore-forming region of the sodium channel. At present, over 500 mutations have been associated with DS and are randomly distributed along the gene (Mulley, et al., *Neurol.* 2006, 67, 1094-1095).

The SCN1A gene is located in the cluster of sodium channel genes on human chromosome 2q24 and encodes the α-pore forming subunits known as $Na_v1.1$ of the neuronal voltage gated sodium channel. The SCN1A gene spans approximately 100 kb of genomic DNA and comprises 26 exons. The SCN1A protein consists of four domains, each with six-transmembrane segments. Two splice variants have been identified that result in a long and short isoform that differ in the presence or absence of 11 amino acids in the cytoplasmic loop between domains 1 and 2, in exon 11 (Miller, et al., 1993-2015, and Mulley, et al., 2005, 25, 535-542, incorporated herein by reference).

Alternative splicing events in SCN1A gene can lead to non-productive mRNA transcripts which in turn can lead to aberrant protein expression, and therapeutic agents which can target the alternative splicing events in SCN1A gene can modulate the expression level of functional proteins in DS patients and/or inhibit aberrant protein expression. Such therapeutic agents can be used to treat a condition caused by SCN1A protein deficiency.

One of the alternative splicing events that can lead to non-productive mRNA transcripts is the inclusion of an extra exon in the mRNA transcript that can induce non-sense mediated mRNA decay. The present disclosure provides compositions and methods for modulating alternative splicing of SCN1A to increase the production of protein-coding mature mRNA, and thus, translated functional SCN1A protein. These compositions and methods include antisense oligomers (ASOs) that can cause exon skipping and promote constitutive splicing of SCN1A pre-mRNA. In various embodiments, functional SCN1A protein can be increased using the methods of the disclosure to treat a condition caused by SCN1A protein deficiency.

In some cases, the disease or condition is SMEB.

In some cases, the disease or condition is GEFS+.

In some cases, the disease or condition is a Febrile seizure (e.g., Febrile seizures, familial, 3A).

In some cases, the disease or condition is autism (also known as autism spectrum disorder or ASD).

In some cases, the disease or condition is migraine (e.g., migraine, familial hemiplegic, 3).

In some cases, the disease or condition is Alzheimer's disease.

In some embodiments, the disease or condition is SCN2A encephalopathy.

In some embodiments, the disease or condition is SCN8A encephalopathy.

In some embodiments, the disease or condition is SCN5A arrhythmia.

In embodiments, the antisense oligonucleotide is administered with one or more agents capable of promoting penetration of the subject antisense oligonucleotide across the blood-brain barrier by any method known in the art. For example, delivery of agents by administration of an adenovirus vector to motor neurons in muscle tissue is described in U.S. Pat. No. 6,632,427, "Adenoviral-vector-mediated gene transfer into medullary motor neurons," incorporated herein by reference. Delivery of vectors directly to the brain, e.g., the striatum, the thalamus, the hippocampus, or the substantia nigra, is described, e.g., in U.S. Pat. No. 6,756,523, "Adenovirus vectors for the transfer of foreign genes into cells of the central nervous system particularly in brain," incorporated herein by reference.

In embodiments, the antisense oligonucleotides are linked or conjugated with agents that provide desirable pharmaceutical or pharmacodynamic properties. In embodiments, the antisense oligonucleotide is coupled to a substance, known in the art to promote penetration or transport across the blood-brain barrier, e.g., an antibody to the transferrin receptor. In embodiments, the antisense oligonucleotide is linked with a viral vector, e.g., to render the antisense compound more effective or increase transport across the blood-brain barrier. In embodiments, osmotic blood brain barrier disruption is assisted by infusion of sugars, e.g., meso erythritol, xylitol, D(+) galactose, D(+) lactose, D(+) xylose, dulcitol, myo-inositol, L(−) fructose, D(−) mannitol, D(+) glucose, D(+) arabinose, D(−) arabinose, cellobiose, D(+) maltose, D(+) raffinose, L(+) rhamnose, D(+) melibiose, D(−) ribose, adonitol, D(+) arabitol, L(−) arabitol, D(+) fucose, L(−) fucose, D(−) lyxose, L(+) lyxose, and L(−) lyxose, or amino acids, e.g., glutamine, lysine, arginine, asparagine, aspartic acid, cysteine, glutamic acid, glycine, histidine, leucine, methionine, phenylalanine, proline, serine, threonine, tyrosine, valine, and taurine. Methods and materials for enhancing blood brain barrier penetration are described, e.g., in U.S. Pat. No. 9,193,969, "Compositions and methods for selective delivery of oligonucleotide molecules to specific neuron types," U.S. Pat. No. 4,866,042, "Method for the delivery of genetic material across the blood brain barrier," U.S. Pat. No. 6,294,520, "Material for passage through the blood-brain barrier," and U.S. Pat. No. 6,936,589, "Parenteral delivery systems," each incorporated herein by reference.

In embodiments, an ASO of the invention is coupled to a dopamine reuptake inhibitor (DRI), a selective serotonin reuptake inhibitor (SSRI), a noradrenaline reuptake inhibitor (NRI), a norepinephrine-dopamine reuptake inhibitor (NDRI), and a serotonin-norepinephrine-dopamine reuptake inhibitor (SNDRI), using methods described in, e.g., U.S. Pat. No. 9,193,969, incorporated herein by reference.

In embodiments, subjects treated using the methods and compositions are evaluated for improvement in condition using any methods known and described in the art.

Methods of Identifying Additional ASOs that Induce Exon Skipping

Also within the scope of the present disclosure are methods for identifying or determining ASOs that induce exon skipping of a SCN1A NIE containing pre-mRNA. For example, a method can comprise identifying or determining ASOs that induce pseudo-exon skipping of a SCN1A NIE containing pre-mRNA. ASOs that specifically hybridize to different nucleotides within the target region of the pre-mRNA may be screened to identify or determine ASOs that improve the rate and/or extent of splicing of the target intron. In some embodiments, the ASO may block or interfere with the binding site(s) of a splicing repressor(s)/silencer. Any method known in the art may be used to identify (determine) an ASO that when hybridized to the target region of the exon results in the desired effect (e.g., pseudo-exon skipping, protein or functional RNA production). These methods also can be used for identifying ASOs that induce exon skipping of the included exon by binding to a targeted region in an intron flanking the included exon, or in a non-included exon. An example of a method that may be used is provided below.

A round of screening, referred to as an ASO "walk" may be performed using ASOs that have been designed to hybridize to a target region of a pre-mRNA. For example, the ASOs used in the ASO walk can be tiled every 5 nucleotides from approximately 100 nucleotides upstream of the 3' splice site of the included exon (e.g., a portion of sequence of the exon located upstream of the target/included exon) to approximately 100 nucleotides downstream of the 3' splice site of the target/included exon and/or from approximately 100 nucleotides upstream of the 5' splice site of the included exon to approximately 100 nucleotides downstream of the 5' splice site of the target/included exon (e.g., a portion of sequence of the exon located downstream of the target/included exon). For example, a first ASO of 15 nucleotides in length may be designed to specifically hybridize to nucleotides +6 to +20 relative to the 3' splice site of the target/included exon. A second ASO may be designed to specifically hybridize to nucleotides +11 to +25 relative to the 3' splice site of the target/included exon. ASOs are designed as such spanning the target region of the pre-mRNA. In embodiments, the ASOs can be tiled more closely, e.g., every 1, 2, 3, or 4 nucleotides. Further, the ASOs can be tiled from 100 nucleotides downstream of the 5' splice site, to 100 nucleotides upstream of the 3' splice site. In some embodiments, the ASOs can be tiled from about 1,160 nucleotides upstream of the 3' splice site, to about 500 nucleotides downstream of the 5' splice site. In some embodiments, the ASOs can be tiled from about 500 nucleotides upstream of the 3' splice site, to about 1,920 nucleotides downstream of the 3' splice site.

One or more ASOs, or a control ASO (an ASO with a scrambled sequence, sequence that is not expected to hybridize to the target region) are delivered, for example by transfection, into a disease-relevant cell line that expresses the target pre-mRNA (e.g., a NIE containing pre-mRNA described herein). The exon skipping effects of each of the ASOs may be assessed by any method known in the art, for example by reverse transcriptase (RT)-PCR using primers that span the splice junction, as described in Example 4. A reduction or absence of a longer RT-PCR product produced using the primers spanning the region containing the included exon (e.g. including the flanking exons of the NIE) in ASO-treated cells as compared to in control ASO-treated cells indicates that splicing of the target NIE has been enhanced. In some embodiments, the exon skipping efficiency (or the splicing efficiency to splice the intron containing the NIE), the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced functional protein production). Any method known in the art for assessing and/or quantifying protein production, such as Western blotting, flow cytometry, immunofluorescence microscopy, and ELISA, can be used.

A second round of screening, referred to as an ASO "micro-walk" may be performed using ASOs that have been designed to hybridize to a target region of a pre-mRNA. The ASOs used in the ASO micro-walk are tiled every 1 nucleotide to further refine the nucleotide acid sequence of the pre-mRNA that when hybridized with an ASO results in exon skipping (or enhanced splicing of NIE).

Regions defined by ASOs that promote splicing of the target intron are explored in greater detail by means of an ASO "micro-walk", involving ASOs spaced in 1-nt steps, as well as longer ASOs, typically 18-25 nt.

As described for the ASO walk above, the ASO micro-walk is performed by delivering one or more ASOs, or a control ASO (an ASO with a scrambled sequence, sequence that is not expected to hybridize to the target region), for example by transfection, into a disease-relevant cell line that expresses the target pre-mRNA. The splicing-inducing effects of each of the ASOs may be assessed by any method known in the art, for example by reverse transcriptase (RT)-PCR using primers that span the NIE, as described herein (see, e.g., Example 4). A reduction or absence of a longer RT-PCR product produced using the primers spanning the NIE in ASO-treated cells as compared to in control ASO-treated cells indicates that exon skipping (or splicing of the target intron containing an NIE) has been enhanced. In some embodiments, the exon skipping efficiency (or the splicing efficiency to splice the intron containing the NIE), the ratio of spliced to unspliced pre-mRNA, the rate of splicing, or the extent of splicing may be improved using the ASOs described herein. The amount of protein or functional RNA that is encoded by the target pre-mRNA can also be assessed to determine whether each ASO achieved the desired effect (e.g., enhanced functional protein production). Any method known in the art for assessing and/or quantifying protein production, such as Western blotting, flow cytometry, immunofluorescence microscopy, and ELISA, can be used.

ASOs that when hybridized to a region of a pre-mRNA result in exon skipping (or enhanced splicing of the intron containing a NIE) and increased protein production may be tested in vivo using animal models, for example transgenic mouse models in which the full-length human gene has been knocked-in or in humanized mouse models of disease. Suitable routes for administration of ASOs may vary depending on the disease and/or the cell types to which delivery of the ASOs is desired. ASOs may be administered, for example, by intrathecal injection, intracerebroventricular injection, intraperitoneal injection, intramuscular injection, subcutaneous injection, intravitreal injection, or intravenous injection. Following administration, the cells, tissues, and/or organs of the model animals may be assessed to determine the effect of the ASO treatment by for example evaluating splicing (efficiency, rate, extent) and protein production by methods known in the art and described herein. The animal models may also be any phenotypic or behavioral indication of the disease or disease severity.

As described herein in various examples, exon 20x in human SCN1A gene is equivalent to exon 21x in mouse SCN1A gene.

Figure 3B:
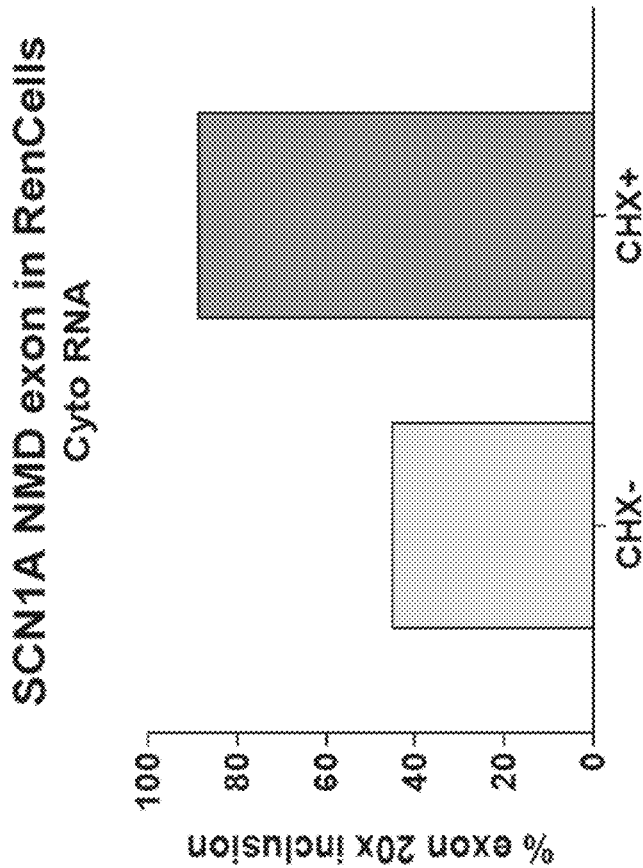
FIG. 3B depicts confirmation of NMD-inducing exon via cycloheximide treatment. RT-PCR analysis using cytoplasmic RNA from DMSO-treated (CHX−) or cycloheximide-treated (CHX+) RenCell VM (human neural progenitor cells) and primers in exon 20 and exon 23 confirmed the presence of a band corresponding to the NMD-inducing exon (20x). The identity of the product was confirmed by sequencing. Densitometry analysis of the bands was performed to calculate percent exon 20x inclusion of total SCN1A transcript. Treatment of RenCell VM with cycloheximide (CHX+) to inhibit NMD led to a 2-fold increase of the product corresponding to the NMD-inducing exon 20x in the cytoplasmic fraction (cf. light grey bar, CHX−, to dark grey bar, CHX+).
Figure 3A:
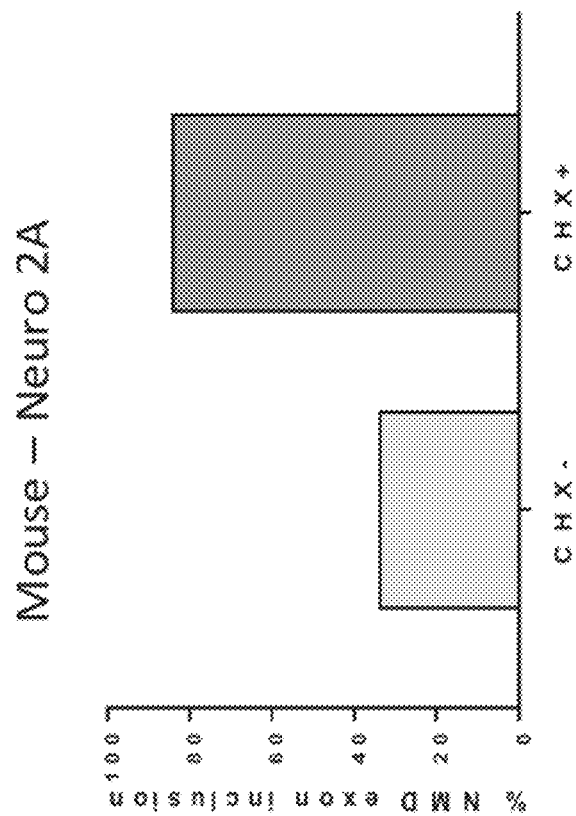
FIG. 3A depicts confirmation of NMD-inducing exon via cycloheximide treatment. RT-PCR analysis using cytoplasmic RNA from DMSO-treated (CHX−) or cycloheximide-treated (CHX+) Neuro 2A (mouse neural progenitor cells) and primers in exon 21 and a downstream exon confirmed the presence of a band corresponding to the NMD-inducing exon (21x). The identity of the product was confirmed by sequencing. Densitometry analysis of the bands was performed to calculate percent exon 21x inclusion of total SCN1A transcript. Treatment of Neuro 2A with cycloheximide (CHX+) to inhibit NMD led to a 2-fold increase of the product corresponding to the NMD-inducing exon 21x in the cytoplasmic fraction (cf. light grey bar, CHX−, to dark grey bar, CHX+).

Also within the scope of the present disclosure is a method to identify or validate an NMD-inducing exon in the presence of an NMD inhibitor, for example, cycloheximide. An exemplary method is provided in FIG. 3 and Example 2.

SPECIFIC EMBODIMENTS

Embodiment 1

A method of modulating expression of SCN1A protein in a cell having an mRNA that contains a non-sense mediated RNA decay-inducing exon (NMD exon mRNA) and encodes SCN1A protein, the method comprising contacting a therapeutic agent to the cell, whereby the therapeutic agent modulates splicing of the NMD exon from the NMD exon mRNA encoding SCN1A protein, thereby modulating the level of processed mRNA encoding SCN1A protein, and modulating expression of SCN1A protein in the cell.

Embodiment 2

A method of treating a disease or condition in a subject in need thereof by modulating expression of SCN1A protein in a cell of the subject, comprising: contacting the cell of the subject with a therapeutic agent that modulates splicing of a non-sense mediated mRNA decay-inducing exon (NMD exon) from an mRNA in the cell that contains the NMD exon and encodes SCN1A, thereby modulating the level of processed mRNA encoding the SCN1A protein, and modulating expression of SCN1A protein in the cell of the subject.

Embodiment 3

The method of embodiment 1 or 2, wherein the therapeutic agent
(a) binds to a targeted portion of the NMD exon mRNA encoding SCN1A;
(b) modulates binding of a factor involved in splicing of the NMD exon mRNA; or
(c) a combination of (a) and (b).

Embodiment 4

The method of embodiment 3, wherein the therapeutic agent interferes with binding of the factor involved in splicing of the NMD exon from a region of the targeted portion.

Embodiment 5

The method of embodiment 3 or 4, wherein the targeted portion is proximal to the NMD exon.

Embodiment 6

The method of any one of embodiments 3 to 5, wherein the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of 5' end of the NMD exon.

Embodiment 7

The method of any one of embodiments 3 to 6, wherein the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides upstream of 5' end of the NMD exon.

Embodiment 8

The method of any one of embodiments 3 to 5, wherein the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of 3' end of the NMD exon.

Embodiment 9

The method of any one of embodiments 3 to 5 or 8, wherein the targeted portion is at least about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides downstream of 3' end of the NMD exon.

Embodiment 10

The method of any one of embodiments 3 to 9, wherein the targeted portion is located in an intronic region between two canonical exonic regions of the NMD exon mRNA encoding SCN1A, and wherein the intronic region contains the NMD exon.

Embodiment 11

The method of any one of embodiments 3 to 10, wherein the targeted portion at least partially overlaps with the NMD exon.

Embodiment 12

The method of any one of embodiments 3 to 11, wherein the targeted portion at least partially overlaps with an intron upstream of the NMD exon.

Embodiment 13

The method of any one of embodiments 3 to 12, wherein the targeted portion comprises 5' NMD exon-intron junction or 3' NMD exon-intron junction.

Embodiment 14

The method of any one of embodiments 3 to 13, wherein the targeted portion is within the NMD exon.

Embodiment 15

The method of any one of embodiments 3 to 14, wherein the targeted portion comprises about 5, 6, 7, 8, 9, 10, 11, 12, 13, 14, 15, 16, 17, 18, 19, 20, 21, 22, 23, 24, 25, 26, 27, 28, 29, 30, or more consecutive nucleotides of the NMD exon.

Embodiment 16

The method of any one of embodiments 1 to 15, wherein the NMD exon mRNA encoding SCN1A comprises a sequence with at least about 80%, 85%, 90%, 95%, 97%, or 100% sequence identity to any one of SEQ ID NOs: 2 or 7-10.

Embodiment 17

The method of any one of embodiments 1 to 16, wherein the NMD exon mRNA encoding SCN1A is encoded by a genetic sequence with at least about 80%, 85%, 90%, 95%, 97%, or 100% sequence identity to SEQ ID NOs: 1 or 3-6.

Embodiment 18

The method of any one of embodiments 3 to 17, wherein the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides upstream of genomic site GRCh37/hg19: chr2:166,863,803.

Embodiment 19

The method of any one of embodiments 3 to 18, wherein the targeted portion is about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides upstream of genomic site GRCh37/hg19: chr2:166,863,803.

Embodiment 20

The method of any one of embodiments 3 to 17, wherein the targeted portion is at most about 1500 nucleotides, about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides downstream of genomic site GRCh37/hg19: chr2:166,863,740.

Embodiment 21

The method of any one of embodiments 3 to 17 or 20, wherein the targeted portion is about 1000 nucleotides, about 800 nucleotides, about 700 nucleotides, about 600 nucleotides, about 500 nucleotides, about 400 nucleotides, about 300 nucleotides, about 200 nucleotides, about 100 nucleotides, about 80 nucleotides, about 70 nucleotides, about 60 nucleotides, about 50 nucleotides, about 40 nucleotides, about 30 nucleotides, about 20 nucleotides, about 10 nucleotides, about 5 nucleotides, about 4 nucleotides, about 2 nucleotides, about 1 nucleotides downstream of genomic site GRCh37/hg19: chr2:166,863,740.

Embodiment 22

The method of any one of embodiments 3 to 21, wherein the targeted portion of the NMD exon mRNA encoding SCN1A comprises a sequence with at least 80%, 85%, 90%, 95%, 97%, or 100% sequence identity to a region comprising at least 8 contiguous nucleic acids of SEQ ID NO: SEQ ID NOs: 2 or 7-10.

Embodiment 23

The method of embodiment 22, wherein the therapeutic agent is an antisense oligomer (ASO) and wherein the ASO comprises a sequence that is at least about 80%, 85%, 90%, 95%, 97%, or 100% identity to any one of SEQ ID NOs: 21-67, 210-256, or 304-379.

Embodiment 24

The method of any one of embodiments 3 to 21, wherein the targeted portion of the NMD exon mRNA encoding SCN1A is within the non-sense mediated RNA decay-inducing exon 20x of SCN1A.

Embodiment 25

The method of embodiment 24, wherein the therapeutic agent is an antisense oligomer (ASO) and wherein the ASO comprises a sequence that is at least about 80%, 85%, 90%, 95%, 97%, or 100% identity to any one of SEQ ID NOs: 42-50, or 231-239.

Embodiment 26

The method of any one of embodiments 3 to 21, wherein the targeted portion of the NMD exon mRNA encoding SCN1A is upstream or downstream of the non-sense mediated RNA decay-inducing exon 20x of SCN1A.

Embodiment 27

The method of embodiment 26, wherein the therapeutic agent is an antisense oligomer (ASO) and wherein the ASO comprises a sequence that is at least about 80%, 85%, 90%, 95%, 97%, or 100% identity to any one of SEQ ID NOs: 21-38, 53-67, 210-227, or 242-256.

Embodiment 28

The method of any one of embodiments 3 to 21, wherein the targeted portion of the NMD exon mRNA comprises an exon-intron junction of exon 20x of SCN1A.

Embodiment 29

The method of embodiment 28, wherein the therapeutic agent is an antisense oligomer (ASO) and wherein the ASO comprises a sequence that is at least about 80%, 85%, 90%, 95%, 97%, or 100% identity to any one of SEQ ID NOs: 39-41, 51, 52, 228-230, 240, or 241.

Embodiment 30

The method of any one of embodiments 1 to 29, wherein the therapeutic agent promotes exclusion of the NMD exon from the processed mRNA encoding SCN1A protein.

Embodiment 31

The method of embodiment 30, wherein exclusion of the NMD exon from the processed mRNA encoding SCN1A protein in the cell contacted with the therapeutic agent is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding SCN1A protein in a control cell.

Embodiment 32

The method of embodiment 30 or 31, wherein the therapeutic agent increases level of the processed mRNA encoding SCN1A protein in the cell.

Embodiment 33

The method of any one of embodiments 30 to 32, wherein an amount of the processed mRNA encoding SCN1A protein in the cell contacted with the therapeutic agent is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of the processed mRNA encoding SCN1A protein in a control cell.

Embodiment 34

The method of any one of embodiments 30 to 33, wherein the therapeutic agent increases expression of SCN1A protein in the cell.

Embodiment 35

The method of any one of embodiments 30 to 34, wherein an amount of SCN1A produced in the cell contacted with the therapeutic agent is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of SCN1A produced in a control cell.

Embodiment 36

The method of any one of embodiments 2 to 35, wherein the disease or condition is induced by a loss-of-function mutation in Nav1.1.

Embodiment 37

The method of any one of embodiments 2 to 36, wherein the disease or condition is associated with haploinsufficiency of the SCN1A gene, and wherein the subject has a first allele encoding a functional SCN1A, and a second allele from which SCN1A is not produced or produced at a reduced level, or a second allele encoding a nonfunctional SCN1A or a partially functional SCN1A.

Embodiment 38

The method of any one of embodiments 2 to 37, wherein the disease or condition is encephalopathy.

Embodiment 39

The method of embodiment 38, wherein the encephalopathy is epileptic encephalopathy.

Embodiment 40

The method of any one of embodiments 2 to 37, wherein the disease or condition is Dravet Syndrome (DS); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); sick sinus syndrome 1; autism; or malignant migrating partial seizures of infancy.

Embodiment 41

The method of embodiment 40, wherein GEFS+ is epilepsy, generalized, with febrile seizures plus, type 2.

Embodiment 42

The method of embodiment 40, wherein the Febrile seizure is Febrile seizures, familial, 3A.

Embodiment 43

The method of embodiment 40, wherein SMEB is SMEB without generalized spike wave (SMEB-SW), SMEB without myoclonic seizures (SMEB-M), SMEB lacking more than one feature of SMEI (SMEB-O), or intractable childhood epilepsy with generalized tonic-clonic seizures (ICEGTC).

Embodiment 44

The method of any one of embodiments 1 to 43, wherein the therapeutic agent promotes exclusion of the NMD exon from the processed mRNA encoding SCN1A protein and increases the expression of SCN1A in the cell.

Embodiment 45

The method of any one of embodiments 1 to 44, wherein the therapeutic agent is an antisense oligomer (ASO) and wherein the ASO comprises a sequence that is at least about 80%, 85%, 90%, 95%, 97%, or 100% complimentary to any one of SEQ ID NOs: 22-24, 26, 27, 29-35, 37-62, 64-67, or 304-379.

Embodiment 46

The method of any one of embodiments 1 to 29, wherein the therapeutic agent inhibits exclusion of the NMD exon from the processed mRNA encoding SCN1A protein.

Embodiment 47

The method of embodiment 46, wherein exclusion of the NMD exon from the processed mRNA encoding SCN1A protein in the cell contacted with the therapeutic agent is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to exclusion of the NMD exon from the processed mRNA encoding SCN1A protein in a control cell.

Embodiment 48

The method of embodiment 46 or 47, wherein the therapeutic agent decreases level of the processed mRNA encoding SCN1A protein in the cell.

Embodiment 49

The method of any one of embodiments 46 to 48, wherein an amount of the processed mRNA encoding SCN1A protein in the cell contacted with the therapeutic agent is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of the processed mRNA encoding SCN1A protein in a control cell.

Embodiment 50

The method of any one of embodiments 46 to 49, wherein the therapeutic agent decreases expression of SCN1A protein in the cell.

Embodiment 51

The method of any one of embodiments 46 to 50, wherein an amount of SCN1A produced in the cell contacted with the therapeutic agent is decreased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to an total amount of SCN1A produced in a control cell.

Embodiment 52

The method of any one of embodiments 2 to 29 or 46 to 49, wherein the disease or condition is induced by a gain-of-function mutation in Nav1.1.

Embodiment 53

The method of embodiment 52, wherein the subject has an allele from which SCN1A is produced at an increased level, or an allele encoding a mutant SCN1A that induces increased activity of $Na_v1.1$ in the cell.

Embodiment 54

The method of embodiment 52 or 53, wherein the disease or condition is migraine.

Embodiment 55

The method of embodiment 54, wherein the migraine is migraine, familial hemiplegic, 3.

Embodiment 56

The method of any one of embodiments 2 to 49, wherein the disease or condition is a $Na_v1.1$ genetic epilepsy.

Embodiment 57

The method of any one of embodiments 46 to 56, wherein the therapeutic agent inhibits exclusion of the NMD exon from the processed mRNA encoding SCN1A protein and decreases the expression of SCN1A in the cell.

Embodiment 58

The method of any one of embodiments 46 to 57, wherein the therapeutic agent is an antisense oligomer (ASO) and wherein the ASO comprises a sequence that is at least about 80%, 85%, 90%, 95%, 97%, or 100% complimentary to any one of SEQ ID NOs: 21, 25, 28, 36, or 63.

Embodiment 59

The method of any one of previous embodiments, wherein the therapeutic agent is an antisense oligomer (ASO) and wherein the antisense oligomer comprises a backbone modification comprising a phosphorothioate linkage or a phosphorodiamidate linkage.

Embodiment 60

The method of any one of previous embodiments, wherein the therapeutic agent is an antisense oligomer (ASO) and wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

Embodiment 61

The method of any one of previous embodiments, wherein the therapeutic agent is an antisense oligomer (ASO) and wherein the antisense oligomer comprises at least one modified sugar moiety.

Embodiment 62

The method of embodiment 61, wherein each sugar moiety is a modified sugar moiety.

Embodiment 63

The method of any one of previous embodiments, wherein the therapeutic agent is an antisense oligomer (ASO) and wherein the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Embodiment 64

The method of any one of embodiments 3 to 63, wherein the therapeutic agent is an antisense oligomer (ASO) and wherein the antisense oligomer is at least 80%, at least 85%, at least 90%, at least 95%, at least 98%, at least 99%, or 100%, complementary to the targeted portion of the NMD exon mRNA encoding the protein.

Embodiment 65

The method of any one of previous embodiments, wherein the method further comprises assessing SCN1A mRNA or protein expression.

Embodiment 66

The method of any one of embodiments 2 to 65, wherein the subject is a human.

Embodiment 67

The method of any one of embodiments 2 to 65, wherein the subject is a non-human animal.

Embodiment 68

The method of any one of embodiments 2 to 65, wherein the subject is a fetus, an embryo, or a child.

Embodiment 69

The method of any one of previous embodiments, wherein the cells are ex vivo.

Embodiment 70

The method of any one of embodiments 2 to 69, wherein the therapeutic agent is administered by intrathecal injection, intracerebroventricular injection, intraperitoneal injection, intramuscular injection, subcutaneous injection, intravitreal, or intravenous injection of the subject.

Embodiment 71

The method of any one of embodiments 2 to 65, wherein the method further comprises administering a second therapeutic agent to the subject.

Embodiment 72

The method of embodiment 71, wherein the second therapeutic agent is a small molecule.

Embodiment 73

The method of embodiment 71, wherein the second therapeutic agent is an ASO.

Embodiment 74

The method of embodiment 73, wherein the ASO comprises a sequence that is at least about 80%, 85%, 90%, 95%, 97%, or 100% complimentary to any one of SEQ ID NOs: 115-161.

Embodiment 75

The method of embodiment 71, wherein the second therapeutic agent corrects intron retention.

Embodiment 76

The method of any one of embodiments 2 to 65, wherein the disease or condition is Alzheimer's Disease, SCN2A encephalopathy, SCN8A encephalopathy, or SCN5A arrythmia.

Embodiment 77

The method of embodiment 30, 32 or 34, wherein the disease or condition is Alzheimer's Disease, SCN2A encephalopathy, SCN8A encephalopathy, or SCN5A arrythmia.

Embodiment 78

A method of treating Dravet Syndrome (DS); Epilepsy, generalized, with febrile seizures plus, type 2; Febrile seizures, familial, 3A; Migraine, familial hemiplegic, 3; Autism; Epileptic encephalopathy, early infantile, 13; Sick sinus syndrome 1; Alzheimer's disease or sudden unexpected death in epilepsy (SUDEP) in a subject in need thereof, by increasing the expression of a target protein or functional RNA by a cell of the subject, wherein the cell has an mRNA that contains a non-sense mediated RNA decay-inducing exon (NMD exon mRNA), and wherein the NMD exon mRNA encodes the target protein or functional RNA, the method comprising contacting the cell of the subject with a therapeutic agent that binds to a targeted portion of the NMD exon mRNA encoding the target protein or functional RNA, whereby the non-sense mediated RNA decay-inducing exon is excluded from the NMD exon mRNA encoding the target protein or functional RNA, thereby increasing the level of processed mRNA encoding the target protein or functional RNA, and increasing the expression of the target protein or functional RNA in the cell of the subject.

Embodiment 79

The method of embodiment 78, wherein the target protein is SCN1A.

Embodiment 80

A method of increasing expression of SCN1A protein by a cell having an mRNA that contains a non-sense mediated RNA decay-inducing exon (NMD exon mRNA) and encodes SCN1A protein, the method comprising contacting the cell an agent that binds to a targeted portion of the NMD exon mRNA encoding SCN1A protein, whereby the non-sense mediated RNA decay-inducing exon is excluded from the NMD exon mRNA encoding SCN1A protein, thereby increasing the level of processed mRNA encoding SCN1A protein, and increasing the expression of SCN1A protein in the cell.

Embodiment 81

A method of treating a disease or condition in a subject in need thereof by increasing the expression of SCN1A protein in a cell of the subject, comprising: contacting the cell of the subject with a therapeutic agent that binds to a targeted portion of a non-sense mediated RNA decay-inducing exon mRNA encoding the SCN1A protein or functional SCN1A RNA, whereby the non-sense mediated RNA decay-inducing exon is excluded from the NMD exon mRNA encoding the SCN1A protein or functional SCN1A RNA, thereby increasing the level of processed mRNA encoding the SCN1A protein or functional SCN1A RNA, and increasing the expression of the SCN1A protein or functional SCN1A RNA in the cell of the subject; wherein the disease or condition is associated with a mutation of a gene other than an SCN1A gene, aberrant expression of a protein encoded by a gene other than an SCN1A gene or aberrant expression of an RNA encoded by a gene other than an SCN1A gene.

Embodiment 82

The method of embodiment 81, wherein a symptom of the disease or condition is reduced by about 2-fold, 3-fold, 4-fold, 5-fold, 6-fold, 7-fold, 8-fold, 9-fold, 10-fold, or more.

Embodiment 83

The method of embodiment 81 or 82, wherein a symptom of the disease or condition is reduced by about 20%, 30%, 40%, 50%, 60%, 70%, 80%, 90%, 95%, or 100% with an increase in expression of the SCN1A protein.

Embodiment 84

The method of any one of embodiments 81 to 83, wherein progression of the disease or condition is reduced by about

67

2-fold, 3-fold, 4-fold, 5-fold, 6-fold, 7-fold, 8-fold, 9-fold, 10-fold, or more with an increase in expression of the SCN1A protein.

Embodiment 85

The method of any one of embodiments 81 to 84, wherein progression of the disease or condition is reduced by about 20%, 30%, 40%, 50%, 60%, 70%, 80%, 90%, 95%, or 100% with an increase in expression of the SCN1A protein.

Embodiment 86

The method of any one of embodiments 81 to 85, wherein increasing the expression of the SCN1A protein or functional SCN1A RNA compensates for the mutation of a gene other than an SCN1A gene, the aberrant expression of a protein encoded by a gene other than an SCN1A gene or the aberrant expression of an RNA encoded by a gene other than an SCN1A gene.

Embodiment 87

The method of any one of embodiments 81 to 86, wherein the disease or condition is epileptic encephalopathy, early infantile, 13.

Embodiment 88

The method of any one of embodiments 81 to 87, wherein the subject has a mutation in the SCN8A gene.

Embodiment 89

The method of any one of embodiments 81 to 86, wherein the disease or condition is sick sinus syndrome 1.

Embodiment 90

The method of any one of embodiments 81 to 86 or 88, wherein the subject has a mutation in the SCN5A gene

Embodiment 91

The method of any one of embodiments 81 to 86, wherein the disease or condition is Alzheimer's disease.

Embodiment 92

A method of treating a disease or condition in a subject in need thereof, comprising administering to the subject a composition comprising an antisense oligomer, the antisense oligomer comprising a sequence of at least 8 contiguous nucleotides that is at least 80%, 85%, 90%, 95%, 97%, or 100% complementary to intron 20 of SCN1A.

Embodiment 93

A method of treating a disease or condition in a subject in need thereof, comprising administering to the subject a composition comprising an antisense oligomer, the antisense oligomer comprising a sequence of at least 8 contiguous nucleotides that is at least 80%, 85%, 90%, 95%, 97%, or 100% complementary to any one of SEQ ID NOs: 7-10.

Embodiment 94

The method of any one of embodiments 78 to 93, wherein the non-sense mediated RNA decay-inducing exon is spliced out from the NMD exon mRNA encoding the target protein or functional RNA.

Embodiment 95

The method of any one of embodiments 78 to 94, wherein the target protein does not comprise an amino acid sequence encoded by the non-sense mediated RNA decay-inducing exon.

Embodiment 96

The method of any one of embodiments 78 to 95, wherein the target protein is a full-length target protein.

Embodiment 97

The method of any one of embodiments 78 to 96, wherein the agent is an antisense oligomer (ASO) complementary to the targeted portion of the NMD exon mRNA.

Embodiment 98

The method of any one of embodiments 78 to 97, wherein the mRNA is pre-mRNA.

Embodiment 99

The method of any one of embodiments 78 to 98, wherein the contacting comprises contacting the therapeutic agent to the mRNA, wherein the mRNA is in a nucleus of the cell.

Embodiment 100

The method of any one of embodiments 78 to 99, wherein the target protein or the functional RNA corrects a deficiency in the target protein or functional RNA in the subject.

Embodiment 101

The method of any one of embodiments 78 to 100, wherein the cells are in or from a subject with a condition caused by a deficient amount or activity of SCN1A protein.

Embodiment 102

The method of any one of embodiments 78 to 101, wherein the deficient amount of the target protein is caused by haploinsufficiency of the target protein, wherein the subject has a first allele encoding a functional target protein, and a second allele from which the target protein is not produced or produced at a reduced level, or a second allele encoding a nonfunctional or partially functional target protein, and wherein the antisense oligomer binds to a targeted portion of a NMD exon mRNA transcribed from the first allele.

Embodiment 103

The method of any one of embodiments 78 to 101, wherein the subject has a condition caused by a disorder resulting from a deficiency in the amount or function of the target protein, wherein the subject has
(a) a first mutant allele from which
   (i) the target protein is produced at a reduced level compared to production from a wild-type allele,
   (ii) the target protein is produced in a form having reduced function compared to an equivalent wild-type protein, or
   (iii) the target protein is not produced, and
(b) a second mutant allele from which
   (i) the target protein is produced at a reduced level compared to production from a wild-type allele,
   (ii) the target protein is produced in a form having reduced function compared to an equivalent wild-type protein, or
   (iii) the target protein is not produced, and
wherein when the subject has a first mutant allele (a)(iii), the second mutant allele is (b)(i) or (b)(ii) and wherein when the subject has a second mutant allele (b)(iii), the first mutant allele is (a)(i) or (a)(ii), and wherein the NMD exon mRNA is transcribed from either the first mutant allele that is (a)(i) or (a)(ii), and/or the second allele that is (b)(i) or (b)(ii).

Embodiment 104

The method of embodiment 103, wherein the target protein is produced in a form having reduced function compared to the equivalent wild-type protein.

Embodiment 105

The method of embodiment 103, wherein the target protein is produced in a form that is fully-functional compared to the equivalent wild-type protein.

Embodiment 106

The method of any one of embodiments 78 to 105, wherein the targeted portion of the NMD exon mRNA is within the non-sense mediated RNA decay-inducing exon.

Embodiment 107

The method of any one of embodiments 78 to 105, wherein the targeted portion of the NMD exon mRNA is either upstream or downstream of the non-sense mediated RNA decay-inducing exon.

Embodiment 108

The method of any one of embodiments 78 to 107, wherein the NMD exon mRNA comprises a sequence with at least about 80%, 85%, 90%, 95%, 97%, or 100% sequence identity to any one of SEQ ID NOs: 2, 7-10, 12, and 17-20.

Embodiment 109

The method of any one of embodiments 78 to 107, wherein the NMD exon mRNA is encoded by a genetic sequence with at least about 80%, 85%, 90%, 95%, 97%, or 100% sequence identity to SEQ ID NOs: 1, 3-6, 11, and 13-16.

Embodiment 110

The method of any one of embodiments 78 to 107, wherein the targeted portion of the NMD exon mRNA comprises a sequence with at least 80%, 85%, 90%, 95%, 97%, or 100% sequence identity to a region comprising at least 8 contiguous nucleic acids of SEQ ID NO: SEQ ID NOs: 2, 7-10, 12, and 17-20.

Embodiment 111

The method of any one of embodiments 78 to 110, wherein the agent is an antisense oligomer (ASO) and wherein the ASO comprises a sequence that is at least about 80%, 85%, 90%, 95%, 97%, or 100% identity to any one of SEQ ID NOs: 21-114.

Embodiment 112

The method of any one of embodiments 78 to 105, wherein the targeted portion of the NMD exon mRNA is within the non-sense mediated RNA decay-inducing exon 20x of SCN1A.

Embodiment 113

The method of embodiment 112, wherein the agent is an antisense oligomer (ASO) and wherein the ASO comprises a sequence that is at least about 80%, 85%, 90%, 95%, 97%, or 100% identity to any one of SEQ ID NOs: 42-50, or 231-239.

Embodiment 114

The method of embodiment any one of embodiments 78 to 105, wherein the targeted portion of the NMD exon mRNA is upstream or downstream of the non-sense mediated RNA decay-inducing exon 20x of SCN1A.

Embodiment 115

The method of embodiment 114, wherein the agent is an antisense oligomer (ASO) and wherein the ASO comprises a sequence that is at least about 80%, 85%, 90%, 95%, 97%, or 100% identity to any one of SEQ ID NOs: 21-38, 53-67, 210-227, or 242-256.

Embodiment 116

The method of any one of embodiments 78 to 105, wherein the targeted portion of the NMD exon mRNA comprises an exon-intron junction of exon 20x of SCN1A.

Embodiment 117

The method of embodiment 116, wherein the agent is an antisense oligomer (ASO) and wherein the ASO comprises a sequence that is at least about 80%, 85%, 90%, 95%, 97%, or 100% identity to any one of SEQ ID NOs: 39-41, 51, 52, 228-230, 240, or 241.

Embodiment 118

The method of any one of embodiments 78 to 105, wherein the targeted portion of the NMD exon mRNA is within the non-sense mediated RNA decay-inducing exon 21x of Scn1a.

Embodiment 119

The method of embodiment 118, wherein the agent is an antisense oligomer (ASO) and wherein the ASO comprises a sequence that is at least about 80%, 85%, 90%, 95%, 97%, or 100% identity to any one of SEQ ID NOs: 89-97.

Embodiment 120

The method of embodiment any one of embodiments 78 to 105, wherein the targeted portion of the NMD exon mRNA is either upstream or downstream of the non-sense mediated RNA decay-inducing exon 21x of Scn1a.

Embodiment 121

The method of embodiment 120, wherein the agent is an antisense oligomer (ASO) and wherein the ASO comprises a sequence that is at least about 80%, 85%, 90%, 95%, 97%, or 100% identity to any one of SEQ ID NOs: 68-85 and 100-114.

Embodiment 122

The method of any one of embodiments 78 to 105, wherein the targeted portion of the NMD exon mRNA comprises an exon-intron junction of exon 21x of Scn1a.

Embodiment 123

The method of embodiment 122, wherein the agent is an antisense oligomer (ASO) and wherein the ASO comprises a sequence that is at least about 80%, 85%, 90%, 95%, 97%, or 100% identity to any one of SEQ ID NOs: 86-88 and 98-99.

Embodiment 124

The method of any one of embodiments 78 to 123, wherein the target protein produced is full-length protein, or wild-type protein.

Embodiment 125

The method of any one of embodiments 78 to 124, wherein the total amount of the processed mRNA encoding the target protein or functional RNA produced in the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of the processed mRNA encoding the target protein or functional RNA produced in a control cell.

Embodiment 126

The method of one any of embodiments 78 to 124, wherein the total amount of target protein produced by the cell contacted with the antisense oligomer is increased about 1.1 to about 10-fold, about 1.5 to about 10-fold, about 2 to about 10-fold, about 3 to about 10-fold, about 4 to about 10-fold, about 1.1 to about 5-fold, about 1.1 to about 6-fold, about 1.1 to about 7-fold, about 1.1 to about 8-fold, about 1.1 to about 9-fold, about 2 to about 5-fold, about 2 to about 6-fold, about 2 to about 7-fold, about 2 to about 8-fold, about 2 to about 9-fold, about 3 to about 6-fold, about 3 to about 7-fold, about 3 to about 8-fold, about 3 to about 9-fold, about 4 to about 7-fold, about 4 to about 8-fold, about 4 to about 9-fold, at least about 1.1-fold, at least about 1.5-fold, at least about 2-fold, at least about 2.5-fold, at least about 3-fold, at least about 3.5-fold, at least about 4-fold, at least about 5-fold, or at least about 10-fold, compared to the total amount of target protein produced by a control cell.

Embodiment 127

The method of any one of embodiments 78 to 126, wherein the agent is an antisense oligomer (ASO) and wherein the antisense oligomer comprises a backbone modification comprising a phosphorothioate linkage or a phosphorodiamidate linkage.

Embodiment 128

The method of any one of embodiments 78 to 127, wherein the agent is an antisense oligomer (ASO) and wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

Embodiment 129

The method of any one of embodiments 78 to 128, wherein the agent is an antisense oligomer (ASO) and wherein the antisense oligomer comprises at least one modified sugar moiety.

Embodiment 130

The method of embodiment 129, wherein each sugar moiety is a modified sugar moiety.

Embodiment 131

The method of any one of embodiments 78 to 130, wherein the agent is an antisense oligomer (ASO) and wherein the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Embodiment 132

The method of any one of embodiments 78 to 131, wherein the agent is an antisense oligomer (ASO) and wherein the antisense oligomer is at least 80%, at least 85%, at least 90%, at least 95%, at least 98%, at least 99%, or

Embodiment 133

The method of any one of embodiments 78 to 132, wherein the method further comprises assessing SCN1A mRNA or protein expression.

Embodiment 134

The method of any one of embodiments 1 to 133, wherein Dravet Syndrome; Epilepsy, generalized, with febrile seizures plus, type 2; Febrile seizures, familial, 3A; Migraine, familial hemiplegic, 3; Autism; Epileptic encephalopathy, early infantile, 13; Sick sinus syndrome 1; Alzheimer's disease or sudden unexpected death in epilepsy (SUDEP) is treated and wherein the antisense oligomer binds to a targeted portion of a SCN1A NMD exon mRNA, wherein the targeted portion is within a sequence selected from SEQ ID NOs: 7-10 and 17-20.

Embodiment 135

The method of any one of embodiments 78 to 134, wherein the subject is a human.

Embodiment 136

The method of any one of embodiments 78 to 135, wherein the subject is a non-human animal.

Embodiment 137

The method of any one of embodiments 78 to 136, wherein the subject is a fetus, an embryo, or a child.

Embodiment 138

The method of any one of embodiments 78 to 137, wherein the cells are ex vivo.

Embodiment 139

The method of any one of embodiments 78 to 138, wherein the therapeutic agent is administered by intrathecal injection, intracerebroventricular injection, intraperitoneal injection, intramuscular injection, subcutaneous injection, intravitreal injection, or intravenous injection of the subject.

Embodiment 140

The method of any of embodiments 78 to 139, wherein the method further comprises administering a second therapeutic agent to the subject.

Embodiment 141

The method of embodiment 140, wherein the second therapeutic agent is a small molecule.

Embodiment 142

The method of embodiment 140, wherein the second therapeutic agent is an ASO.

Embodiment 143

The method of embodiment 142, wherein the ASO comprises a sequence that is at least about 80%, 85%, 90%, 95%, 97%, or 100% identity to any one of SEQ ID NOs: 115-161.

Embodiment 144

The method of any one of embodiments 140 to 142, wherein the second therapeutic agent corrects intron retention.

Embodiment 145

An antisense oligomer as used in a method of any of embodiments 78 to 144.

Embodiment 146

An antisense oligomer comprising a sequence with at least about 80%, 85%, 90%, 95%, 97%, or 100% sequence identity to any one of SEQ ID NOs: 21-114.

Embodiment 147

A pharmaceutical composition comprising the antisense oligomer of embodiment 145 or 146 and an excipient.

Embodiment 148

A method of treating a subject in need thereof, comprising administering the pharmaceutical composition of embodiment 147 to the subject, wherein the administering is by intrathecal injection, intracerebroventricular injection, intraperitoneal injection, intramuscular injection, subcutaneous injection, intravitreal injection, or intravenous injection.

Embodiment 149

A composition comprising a therapeutic agent for use in a method of increasing expression of a target protein or a functional RNA by cells to treat a disease or condition associated with a deficient protein or deficient functional RNA in a subject in need thereof, wherein the deficient protein or deficient functional RNA is deficient in amount or activity in the subject, wherein the target protein is:
(a) the deficient protein; or
(b) a compensating protein which functionally augments or replaces the deficient protein or in the subject;
and wherein the functional RNA is:
(c) the deficient RNA; or
(d) a compensating functional RNA which functionally augments or replaces the deficient functional RNA in the subject;
wherein the therapeutic agent enhances exclusion of the non-sense mediated RNA decay-inducing exon from the NMD exon mRNA encoding the target protein or functional RNA, thereby increasing production or activity of the target protein or the functional RNA in the subject.

Embodiment 150

A composition comprising a therapeutic agent for use in a method of treating a disease or condition in a subject in need thereof, the method comprising the step of modulating expression of SCN1A protein by cells of the subject, wherein the cells have an mRNA that contains a non-sense mediated RNA decay-inducing exon (NMD exon mRNA) and encodes SCN1A protein, the method comprising contacting the cells with the therapeutic agent, whereby exclusion of the non-sense mediated RNA decay-inducing exon from the NMD exon mRNA that encodes SCN1A protein is modulated, thereby modulating the level of processed mRNA encoding SCN1A protein, and modulating the expression of SCN1A protein in the cells of the subject.

Embodiment 151

The composition of embodiment 150, wherein the disease or condition is selected from the group consisting of: Dravet Syndrome (DS); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); sick sinus syndrome 1; autism; or migraine, familial hemiplegic, 3; and Alzheimer's Diseases.

Embodiment 152

The composition of any one of embodiments 150 to 151, wherein the SCN1A protein and NMD exon mRNA are encoded by the SCN1A gene.

Embodiment 153

The composition of any one of embodiments 149 to 152, wherein the non-sense mediated RNA decay-inducing exon is spliced out from the NMD exon mRNA encoding the SCN1A protein.

Embodiment 154

The composition of any one of embodiments 149 to 153, wherein the SCN1A protein does not comprise an amino acid sequence encoded by the non-sense mediated RNA decay-inducing exon.

Embodiment 155

The composition of any one of embodiments 149 to 154, wherein the SCN1A protein is a full-length SCN1A protein.

Embodiment 156

The composition of any one of embodiments 149 to 155, wherein the therapeutic agent is an antisense oligomer (ASO) complementary to the targeted portion of the NMD exon mRNA.

Embodiment 157

The composition of any of embodiments 149 to 156, wherein the therapeutic agent is an antisense oligomer (ASO) and wherein the antisense oligomer targets a portion of the NMD exon mRNA that is within the non-sense mediated RNA decay-inducing exon.

Embodiment 158

The composition of any of embodiments 149 to 156, wherein the therapeutic agent is an antisense oligomer (ASO) and wherein the antisense oligomer targets a portion of the NMD exon mRNA that is upstream or downstream of the non-sense mediated RNA decay-inducing exon.

Embodiment 159

The composition of any one of embodiments 149 to 158, wherein the target protein is SCN1A.

Embodiment 160

The composition of embodiment 159, wherein the NMD exon mRNA comprises a sequence with at least about 80%, 85%, 90%, 95%, 97%, or 100% sequence identity to any one of SEQ ID NOs: 2, 7-10, 12, and 17-20.

Embodiment 161

The composition of embodiment 159, wherein the NMD exon mRNA is encoded by a genetic sequence with at least about 80%, 85%, 90%, 95%, 97%, or 100% sequence identity to SEQ ID NO: 1, 3-6, 11, and 13-16.

Embodiment 162

The composition of embodiment 159, wherein the targeted portion of the NMD exon mRNA comprises a sequence with at least 80%, 85%, 90%, 95%, 97%, or 100% sequence identity to a region comprising at least 8 contiguous nucleic acids of SEQ ID NO: 2, 7-10, 12, and 17-20.

Embodiment 163

The composition of any one of embodiments 159 to 162, wherein the targeted portion of the NMD exon mRNA (i) is within non-sense mediated RNA decay-inducing exon 20x, (ii) is upstream or downstream of non-sense mediated RNA decay-inducing exon 20x, or (iii) comprises an exon-intron junction of non-sense mediated RNA decay-inducing exon 20x.

Embodiment 164

The composition of any one of embodiments 159 to 163, wherein the therapeutic agent is an antisense oligomer (ASO) and wherein the ASO comprises a sequence that is at least about 80%, 85%, 90%, 95%, 97%, or 100% identity to any one of SEQ ID NOs: 21-114.

Embodiment 165

The composition of any one of embodiments 149 to 164, wherein the disease or condition is induced by a loss-of-function mutation in Nav1.1.

Embodiment 166

The composition of any one of embodiments 149 to 165, wherein the disease or condition is associated with haploinsufficiency of the SCN1A gene, and wherein the subject has a first allele encoding a functional SCN1A, and a second allele from which SCN1A is not produced or produced at a reduced level, or a second allele encoding a nonfunctional SCN1A or a partially functional SCN1A.

Embodiment 167

The composition of any one of embodiments 149 to 166, wherein the disease or condition is encephalopathy, optionally induced by a loss-of-function mutation in Nav1.1.

Embodiment 168

The composition of embodiment 167, wherein the encephalopathy is epileptic encephalopathy.

Embodiment 169

The composition of embodiment 165 or 166, wherein the disease or condition is Dravet Syndrome (DS); severe myoclonic epilepsy of infancy (SMEI)-borderland (SMEB); Febrile seizure (FS); epilepsy, generalized, with febrile seizures plus (GEFS+); epileptic encephalopathy, early infantile, 13; cryptogenic generalized epilepsy; cryptogenic focal epilepsy; myoclonic-astatic epilepsy; Lennox-Gastaut syndrome; West syndrome; idiopathic spasms; early myoclonic encephalopathy; progressive myoclonic epilepsy; alternating hemiplegia of childhood; unclassified epileptic encephalopathy; sudden unexpected death in epilepsy (SUDEP); sick sinus syndrome 1; autism; or malignant migrating partial seizures of infancy.

Embodiment 170

The composition of embodiment 168, wherein GEFS+ is epilepsy, generalized, with febrile seizures plus, type 2.

Embodiment 171

The composition of embodiment 168, wherein the Febrile seizure is Febrile seizures, familial, 3A.

Embodiment 172

The composition of embodiment 168, wherein SMEB is SMEB without generalized spike wave (SMEB-SW), SMEB without myoclonic seizures (SMEB-M), SMEB lacking more than one feature of SMEI (SMEB-O), or intractable childhood epilepsy with generalized tonic-clonic seizures (ICEGTC).

Embodiment 173

The composition of any one of embodiments 165 to 172, wherein the therapeutic agent promotes exclusion of the NMD exon from the processed mRNA encoding SCN1A protein and increases the expression of SCN1A in the cell.

Embodiment 174

The composition of any one of embodiments 165 to 173, wherein the therapeutic agent is an antisense oligomer (ASO) and wherein the ASO comprises a sequence that is at least about 80%, 85%, 90%, 95%, 97%, or 100% complimentary to any one of SEQ ID NOs: 22-24, 26, 27, 29-35, 37-62, or 64-67.

Embodiment 175

The composition of any one of embodiments 149 to 164, wherein the disease or condition is induced by a gain-of-function mutation in Nav1.1.

Embodiment 176

The composition of any one of embodiments 149 to 164 or 175, wherein the subject has an allele from which SCN1A is produced at an increased level, or an allele encoding a mutant SCN1A that induces increased activity of $Na_v1.1$ in the cell.

Embodiment 177

The composition of any one of embodiments 149 to 164, 175, or 176, wherein the disease or condition is migraine.

Embodiment 178

The composition of embodiment 177, wherein the migraine is migraine, familial hemiplegic, 3.

Embodiment 179

The composition of any one of embodiments 149 to 164, 175, or 176, wherein the disease or condition is a $Na_v1.1$ genetic epilepsy.

Embodiment 180

The composition of any one of embodiments 149 to 164, or 175 to 179, wherein the therapeutic agent inhibits exclusion of the NMD exon from the processed mRNA encoding SCN1A protein and decreases the expression of SCN1A in the cell.

Embodiment 181

The composition of any one of embodiments 149 to 164, or 175 to 180, wherein the therapeutic agent is an antisense oligomer (ASO) and wherein the ASO comprises a sequence that is at least about 80%, 85%, 90%, 95%, 97%, or 100% complimentary to any one of SEQ ID NOs: 21, 25, 28, 36, or 63.

Embodiment 182

The composition of any one of embodiments 149 to 181, wherein the processed mRNA encoding the target protein or functional RNA is a full-length mature mRNA, or a wild-type mature mRNA.

Embodiment 183

The composition of any one of embodiments 149 to 182, wherein the target protein produced is full-length protein, or wild-type protein.

Embodiment 184

The composition of any one of embodiments 149 to 183, wherein the therapeutic agent is an antisense oligomer (ASO) and wherein the antisense oligomer comprises a backbone modification comprising a phosphorothioate linkage or a phosphorodiamidate linkage.

Embodiment 185

The composition of any of embodiments 149 to 184 wherein the therapeutic agent is an antisense oligomer (ASO) and wherein said antisense oligomer is an antisense oligonucleotide.

Embodiment 186

The composition of any of embodiments 149 to 185, wherein the therapeutic agent is an antisense oligomer (ASO) and wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

Embodiment 187

The composition of any of embodiments 149 to 186, wherein the therapeutic agent is an antisense oligomer (ASO) and wherein the antisense oligomer comprises at least one modified sugar moiety.

Embodiment 188

The composition of embodiment 187, wherein each sugar moiety is a modified sugar moiety.

Embodiment 189

The composition of any of embodiments 149 to 188, wherein the therapeutic agent is an antisense oligomer (ASO) and wherein the antisense oligomer consists of from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Embodiment 190

A composition comprising an antisense oligomer, the antisense oligomer comprising a sequence of at least 8 contiguous nucleotides that is at least 80%, 85%, 90%, 95%, 97%, or 100% complementary to intron 20 of SCN1A.

Embodiment 191

A composition comprising an antisense oligomer, the antisense oligomer comprising a sequence of at least 8 contiguous nucleotides that is at least 80%, 85%, 90%, 95%, 97%, or 100% complementary to any one of SEQ ID NOs: 7-10.

Embodiment 192

A pharmaceutical composition comprising the therapeutic agent of any of the compositions of embodiments 149 to 191, and an excipient.

Embodiment 193

A method of treating a subject in need thereof, comprising administering the pharmaceutical composition of embodiment 192 to the subject, wherein the administering is by intrathecal injection, intracerebroventricular injection, intraperitoneal injection, intramuscular injection, subcutaneous injection, intravitreal injection, or intravenous injection.

Embodiment 194

A pharmaceutical composition comprising: an antisense oligomer that hybridizes to a target sequence of a SCN1A mRNA transcript, wherein the SCN1A mRNA transcript comprises a non-sense mediated RNA decay-inducing exon, wherein the antisense oligomer induces exclusion of the non-sense mediated RNA decay-inducing exon from the SCN1A mRNA transcript; and a pharmaceutical acceptable excipient.

Embodiment 195

The pharmaceutical composition of embodiment 194, wherein the SCN1A mRNA transcript is a SCN1A NMD exon mRNA transcript.

Embodiment 196

The pharmaceutical composition of embodiment 194 or 195, wherein the targeted portion of the SCN1A NMD exon mRNA transcript (i) is within non-sense mediated RNA decay-inducing exon 20x, (ii) is upstream or downstream of non-sense mediated RNA decay-inducing exon 20x, or (iii) comprises an exon-intron junction of non-sense mediated RNA decay-inducing exon 20x.

Embodiment 197

The pharmaceutical composition of embodiment 194 or 196, wherein the SCN1A NMD exon mRNA transcript is encoded by a genetic sequence with at least about 80%, 85%, 90%, 95%, 96%, 97%, 98%, 99% or 100% sequence identity to any one of SEQ ID NOs: 1, 3-6, 11, and 13-16.

Embodiment 198

The pharmaceutical composition of embodiment 194 or 196, wherein the SCN1A NMD exon mRNA transcript comprises a sequence with at least about 80%, 85%, 90%, 95%, 96%, 97%, 98%, 99% or 100% sequence identity to any one of SEQ ID NOs: 2, 7-10, 12, and 17-20.

Embodiment 199

The pharmaceutical composition of embodiment 194, wherein the antisense oligomer comprises a backbone modification comprising a phosphorothioate linkage or a phosphorodiamidate linkage.

Embodiment 200

The pharmaceutical composition of embodiment 194, wherein the antisense oligomer is an antisense oligonucleotide.

Embodiment 201

The pharmaceutical composition of embodiment 194, wherein the antisense oligomer comprises a phosphorodiamidate morpholino, a locked nucleic acid, a peptide nucleic acid, a 2'-O-methyl, a 2'-Fluoro, or a 2'-O-methoxyethyl moiety.

Embodiment 202

The pharmaceutical composition of embodiment 194, wherein the antisense oligomer comprises at least one modified sugar moiety.

Embodiment 203

The pharmaceutical composition of embodiment 194, wherein the antisense oligomer comprises from 8 to 50 nucleobases, 8 to 40 nucleobases, 8 to 35 nucleobases, 8 to 30 nucleobases, 8 to 25 nucleobases, 8 to 20 nucleobases, 8 to 15 nucleobases, 9 to 50 nucleobases, 9 to 40 nucleobases, 9 to 35 nucleobases, 9 to 30 nucleobases, 9 to 25 nucleobases, 9 to 20 nucleobases, 9 to 15 nucleobases, 10 to 50 nucleobases, 10 to 40 nucleobases, 10 to 35 nucleobases, 10 to 30 nucleobases, 10 to 25 nucleobases, 10 to 20 nucleobases, 10 to 15 nucleobases, 11 to 50 nucleobases, 11 to 40 nucleobases, 11 to 35 nucleobases, 11 to 30 nucleobases, 11 to 25 nucleobases, 11 to 20 nucleobases, 11 to 15 nucleobases, 12 to 50 nucleobases, 12 to 40 nucleobases, 12 to 35 nucleobases, 12 to 30 nucleobases, 12 to 25 nucleobases, 12 to 20 nucleobases, or 12 to 15 nucleobases.

Embodiment 204

The pharmaceutical composition of embodiment 194 or 195, wherein the antisense oligomer is at least 80%, at least 85%, at least 90%, at least 95%, at least 98%, at least 99%, or is 100% complementary to a targeted portion of the SCN1A NMD exon mRNA transcript.

Embodiment 205

The pharmaceutical composition of embodiment 194 or 195 wherein the targeted portion of the SCN1A NMD exon mRNA transcript is within a sequence selected from SEQ ID NOs: 2, 7-10, 12, and 17-20.

Embodiment 206

The pharmaceutical composition of embodiment 194, wherein the antisense oligomer comprises a nucleotide sequence that is at least about 80%, 85%, 90%, 91%, 92%, 93%, 94%, 95%, 96%, 97%, 98%, or 99% sequence identity to any one of SEQ ID NOs: 21-114.

Embodiment 207

The pharmaceutical composition of embodiment 194, wherein the antisense oligomer comprises a nucleotide sequence selected from SEQ ID NOs: 21-114.

Embodiment 208

The pharmaceutical composition of any one of the embodiments 194 to 207, wherein the pharmaceutical composition is formulated for intrathecal injection, intracerebroventricular injection, intraperitoneal injection, intramuscular injection, subcutaneous injection, intravitreal injection, or intravenous injection.

Embodiment 209

A method of inducing processing of a deficient SCN1A mRNA transcript to facilitate removal of a non-sense mediated RNA decay-inducing exon to produce a fully processed SCN1A mRNA transcript that encodes a functional form of a SCN1A protein, the method comprising:
(a) contacting an antisense oligomer to a target cell of a subject;
(b) hybridizing the antisense oligomer to the deficient SCN1A mRNA transcript, wherein the deficient SCN1A mRNA transcript is capable of encoding the functional form of a SCN1A protein and comprises at least one non-sense mediated RNA decay-inducing exon;
(c) removing the at least one non-sense mediated RNA decay-inducing exon from the deficient SCN1A mRNA transcript to produce the fully processed SCN1A mRNA transcript that encodes the functional form of SCN1A protein; and
(d) translating the functional form of SCN1A protein from the fully processed SCN1A mRNA transcript.

Embodiment 210

A method of treating a subject having a condition caused by a deficient amount or activity of SCN1A protein comprising administering to the subject an antisense oligomer comprising a nucleotide sequence with at least about 80%, 85%, 90%, 91%, 92%, 93%, 94%, 95%, 96%, 97%, 98%, or 99% sequence identity to any one of SEQ ID NOs: 24-114.

Embodiment 211

A method of screening for an agent that increases gene expression of a target protein or functional RNA by a cell, wherein the cell has an mRNA that contains a non-sense mediated RNA decay-inducing exon (NMD exon mRNA), and wherein the NMD exon mRNA encodes the target protein or functional RNA, the method comprising
(a) contacting a test agent that targets the NMD exon mRNA to a first cell;
(b) contacting a control agent to a second cell;
(c) determining a first level in the first cell, wherein the first level is a level of (i) an RNA transcript encoded by the NMD exon mRNA that does not comprise the RNA decay-inducing exon, or (ii) a protein encoded by the NMD exon mRNA that does not comprise an amino acid sequence encoded by the RNA decay-inducing exon;
(d) determining a second level in the second cell, wherein the second level is a level of (i) an RNA transcript encoded by the NMD exon mRNA that does not comprise the RNA decay-inducing exon, or (ii) a protein encoded by the NMD exon mRNA that does not comprise an amino acid sequence encoded by the RNA decay-inducing exon;
wherein the first level is higher than the second level; and
(e) selecting the test agent.

Embodiment 212

A method of screening for an agent that increases gene expression of a target protein or functional RNA by a cell, wherein the cell has an mRNA that contains a non-sense mediated RNA decay-inducing exon (NMD exon mRNA), and wherein the NMD exon mRNA encodes the target protein or functional RNA, the method comprising
(a) contacting a test agent that targets the NMD exon mRNA to a first cell;
(b) contacting a control agent to a second cell;
(c) determining a first level in the first cell, wherein the first level is a level of (i) an RNA transcript encoded by the NMD exon mRNA that comprises the RNA decay-inducing exon, or (ii) a protein encoded by the NMD exon mRNA that comprises an amino acid sequence encoded by the RNA decay-inducing exon;
(d) determining a second level in the second cell, wherein the second level is a level of (i) an RNA transcript encoded by the NMD exon mRNA that comprises the RNA decay-inducing exon, or (ii) a protein encoded by the NMD exon mRNA that comprises an amino acid sequence encoded by the RNA decay-inducing exon;
wherein the first level is lower than the second level; and
(e) selecting the test agent.

Embodiment 213

The method of embodiment 211 or 212, wherein the method comprises contacting a protein synthesis inhibitor to the first cell and the second cell; wherein the first level is a level of an RNA transcript encoded by the NMD exon mRNA that comprises the RNA decay-inducing exon; and wherein the second level is a level of an RNA transcript encoded by the NMD exon mRNA that comprises the RNA decay-inducing exon.

Embodiment 214

A method of treating Dravet Syndrome (DS), Epilepsy, generalized, with febrile seizures plus, type 2; Febrile seizures, familial, 3A; Migraine, familial hemiplegic, 3; Autism; Epileptic encephalopathy, early infantile, 13; Sick sinus syndrome 1; Alzheimer's disease or SUDEP (sudden unexpected death in epilepsy) in a subject in need thereof, by increasing the expression of a target protein or functional RNA by a cell of the subject, wherein the cell has an mRNA that contains a non-sense mediated RNA decay-inducing exon (NMD exon mRNA), and wherein the NMD exon mRNA encodes the target protein or functional RNA, the method comprising contacting the cell of the subject with a therapeutic agent that modulates splicing of the NMD exon mRNA encoding the target protein or functional RNA, whereby the non-sense mediated RNA decay-inducing exon is excluded from the NMD exon mRNA encoding the target protein or functional RNA, thereby increasing the level of processed mRNA encoding the target protein or functional RNA, and increasing the expression of the target protein or functional RNA in the cell of the subject.

Embodiment 215

A method of increasing expression of SCN1A protein by a cell having an mRNA that contains a non-sense mediated RNA decay-inducing exon (NMD exon mRNA) and encodes SCN1A protein, the method comprising contacting the cell an agent that modulates splicing of the NMD exon mRNA encoding SCN1A protein, whereby the non-sense mediated RNA decay-inducing exon is excluded from the NMD exon mRNA encoding SCN1A protein, thereby increasing the level of processed mRNA encoding SCN1A protein, and increasing the expression of SCN1A protein in the cell.

Embodiment 216

The method of embodiment 214 or 215, wherein the agent (a) binds to a targeted portion of the NMD exon mRNA encoding the target protein or functional RNA;
(b) binds to one or more components of a spliceosome; or
(c) a combination of (a) and (b).

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

EXAMPLES

The present invention will be more specifically illustrated by the following Examples. However, it should be understood that the present invention is not limited by these examples in any manner.

Example 1: Identification of NMD-Inducing Exon Inclusion Events in SCN1A Transcripts by RNAseq Using Next Generation Sequencing Whole transcriptome shotgun sequencing was carried out using next generation sequencing to reveal a snapshot of transcripts produced by the SCN1A gene to identify NIE inclusion events. For this purpose, polyA+RNA from nuclear and cytoplasmic fractions of HCN (human cortical neurons) was isolated and cDNA libraries constructed using Illumina's TruSeq Stranded mRNA library Prep Kit. The libraries were pair-end sequenced resulting in 100-nucleotide reads that were mapped to the human genome (February 2009, GRCh37/hg19 assembly). The sequencing results for SCN1A are shown in FIG. 2. Briefly, FIG. 2 shows the mapped reads visualized using the UCSC genome browser (operated by the UCSC Genome Informatics Group (Center for Biomolecular Science & Engineering, University of California, Santa Cruz, 1156 High Street, Santa Cruz, Calif. 95064) and described by, e.g., Rosenbloom, et al., 2015, "The UCSC Genome Browser database: 2015 update," Nucleic Acids Research 43, Database Issue, doi: 10.1093/nar/gku1177) and the coverage and number of reads can be inferred by the peak signals. The height of the peaks indicates the level of expression given by the density of the reads in a particular region. The upper panel shows a graphic representation of the SCN1A gene to scale. The conservation level across 100 vertebrate species is shown as peaks. The highest peaks correspond to exons (black boxes), while no peaks are observed for the majority of the introns (lines with arrow heads). Peaks of conservation were identified in intron 20 (NM_006920), shown in the middle panel. Inspection of the conserved sequences identified an exon-like sequence of 64 bp (bottom panel, sequence highlighted in grey) flanked by 3' and 5' splice sites (underlined sequence). Inclusion of this exon leads to a frameshift and the introduction of a premature termination codon in exon 21 rendering the transcript a target of NMD.

Exemplary SCN1A gene, pre-mRNA, exon, and intron sequences are summarized in Table 2. The sequence for each exon or intron is summarized in Table 3.

TABLE 2

List of target SCN1A gene and pre-mRNA sequences.

| Species | SEQ ID NO. | Sequence Type |
|---|---|---|
| Human | SEQ ID NO. 1 | SCN1A gene (NC_000002.12) |
| | SEQ ID NO. 2 | SCN1A pre-mRNA (encoding e.g., SCN1A mRNA NM_006920.5) |
| | SEQ ID NO. 3 | Exon 20 gene |
| | SEQ ID NO. 4 | Intron 20 gene |
| | SEQ ID NO. 5 | Exon 21 gene |
| | SEQ ID NO. 6 | Exon 20x gene |
| | SEQ ID NO. 7 | Exon 20 pre-mRNA |

TABLE 2-continued

List of target SCN1A gene and pre-mRNA sequences.

| Species | SEQ ID NO. | Sequence Type |
|---|---|---|
| | SEQ ID NO. 8 | Intron 20 pre-mRNA |
| | SEQ ID NO. 9 | Exon 21 pre-mRNA |
| | SEQ ID NO. 10 | Exon 20x pre-mRNA |
| Mouse | SEQ ID NO. 11 | SCN1A gene (NC_000068.7) |
| | SEQ ID NO. 12 | SCN1A pre-mRNA (encoding e.g., SCN1A mRNA NM_001313997.1) |
| | SEQ ID NO. 13 | Exon 21 gene |
| | SEQ ID NO. 14 | Intron 21 gene |
| | SEQ ID NO. 15 | Exon 22 gene |
| | SEQ ID NO. 16 | Exon 21x gene |
| | SEQ ID NO. 17 | Exon 21 pre-mRNA |
| | SEQ ID NO. 18 | Intron 21 pre-mRNA |
| | SEQ ID NO. 19 | Exon 22 pre-mRNA |
| | SEQ ID NO. 20 | Exon 21x pre-mRNA |

TABLE 3

Sequences of target exon or intron in SCN1A pre-mRNA transcripts.

| SEQ ID NO. | Sequence Type | Sequence |
|---|---|---|
| SEQ ID NO. 7 | Exon 20 pre-mRNA | GUUUCAUUGGUCAGUUUAACAGCAAAUGCCUUGGGUUACUC AGAACUUGGAGCCAUCAAAUCUCUCAGGACACUAAGAGCUC UGAGACCUCUAAGAGCCUUAUCUCGAUUUGAAGGGAUGAGG |
| SEQ ID NO. 8 | Intron 20 pre-mRNA | guaagaaaaugaaagaaccugaaguauuguauauagccaaaauuaaacuaaauuaaauuuag aaaaggaaaaucuaugcaugcaaaaggaauggcaaauucuugcaaaauugcuacuuuuauugu uuuaucuguugcauauuuacuucuaggugauaugcaagagaaauaggccucucuugaaauga uauaauaucauuuacucgcugugcuuuauuuaaaugacuuuauuuccuaauccaucuuggag uuuccuuacaaaucuauauacaaaaaaaagcugaugcauuauuaaaguacuaugaguaaugau auaauggaaaucuaaaguaaauucuauaucaggauacuuauucuuugugaugauauacuguac uuaacgaguuuuccugaaaauaaaugugaaucacacaugugccuaaguaugaguguuaagaaa aaaaugaaaggaguuguuaaacuuuuugucuguauaaugccaaaguuugcauuauuugaaua uauucaagauuagaugguuagauauuaagguugacugaauuuauaaaacuaguaauacuaa cuuaaagauuacauacaaauccacaucauuuuuauaacaauaaaguaaaacacuuauaaugaac agaaaauauaauuugacucauuacuauaggaauuuauacauuaauccuuaacuugcaucuua uuggucagagucacacaaaaauguauuuuaauccuuuucaaagaugcaauaaucauuuuccau caugcauaacagauuagaaauuuugccauuauugacuuauuuuccaugccuuuuuuacggc augaagcauuaguuuauagauauauaauauaaaaaauuaguucugcuuuuuuuaaaaaaaa auauuaucaaaacaaaacacugaauugugugauccaauagaaaaacacugcucuuucaccuc cuaaggugguaguuacuuuuauggaaacuaagcuguauuguagacuuccauuugcacuuugua gauuguuuauagccuuaguuucucuucaaguucuuauuauaaaaugucacuuuguaagaacg uaggacuugucuucgauuucccuaacauauaugaaaacuuugcccucauuaucgacaacucag aacaauauaauacaaguaguccucuuuuauuucucacagagagccucaaauuuucaccaaaau guuaacagaaauuaucucuggggguguaaagaauuaagucuguuuccauuuauaaaaaagcugaucu uaucgguauacuuuuaauuuucagaaauaaccauaucuauaauuauuaaucaauaaugccu uuuauauuaaagaggguuaguuuugaaacuuggaguuuuagacauaaaauccuuauaaaug cugauagauauaacuaauaguuuaaaauggucagauuuaugaauauggcucuauuccucau aaugacaacauacacacagcacuaaaaaugacuaaaucucuucaauacguguuuggcauuguaga gucaaaauaaacguuauaaauugauucuauuuuuuauacuucuaguguuuuggauauuuauuu uguaaaaauaaaucaugaaugauggugagguuggauaaagaaugaugauuaugauuuggga aguagauuugaacaugcucagaaacucucauuuaauucuuugcccuagcagcauaaaaucac aauagcugcgucaaagcguaacucaggcacucauuuuauuuguguucuguauuuuuuuc aaagcaugugcuuuuaugcaacauuacugaauaaagcauguugauacagugcuuugauauagaag uuagaaaguaacaaauaaauuaucaucacguugcacuuuguguuuugcauguuuuaugcaca uuucuggcugacagcuuuaaacauuuauuguauuucaaauuuccaguccaaauuuuucaac uuguaaaauuaaacugaguguaauugaugucgugaauaucuagggugaaaauaaaauuguguu uaaauuuguauuuuaauuuccuaaccuaggaaacuuaaaaccuucuuuuucaaaagaac ucaagucuuaauggauaggggaaacagacggagagcaucaugaacaaaaaguaacaccaaaugu ucugucauaucagauuucuaacuaauaacaaacuauauauuucuauuuuguauaggauaauc uugcuccaacuuggauggggguggagcgcugguuccuccccugagcccuuuauuaugggacu guauuaccccuuuugcuaccuuuaaaucucugcacugugacuuugguguaguggggugaggg agggauugggaagggguacuauuauugcaccacaguaggggaaaauacauuauuuuacauccuaa ucccccucuuuucaauugucuaaaauuucauugaaaaaaaaaaaaaccuuuaugaauuuccc ucuugggauuuuaaccccaaugguugauaucuuuauuaaguuucauugaauaugauuuagu uauguguauaugggaguuauccaucuuugggggagauuacuggauugguguagggcgggggaccc cugguguaagaaugauuaugugaaaaaacaauuuaacuuguuaagcucaugauacuguuugag |

TABLE 3 -continued

Sequences of target exon or intron in SCN1A pre-mRNA transcripts.

| SEQ ID NO. | Sequence Type | Sequence |
|---|---|---|
| | | gcauacagccccugcuguuuaguacauuggucuggguccugaaaauuaccaguuagauacca ucaguugauuauugauaugauaugagcagauacuagggugcaauauuucagguuucauaagac ugguauugauugugaccacucucauuuuuuauugug uaaguucauauggggu uauuuucaa aauguuaacaaggcaaaaauauauuaagaaauaguugaauaagcacauguga auugug uugu aaacaaaaaguuagaauaaaaaaauccacuuauuugaauuaugcagaauagaauacauaccuag aaauaaaacaaaaacgucuuaucaugaguauuaagauaaaauuuaaggcauaaacucacuucu uagaauaaguaacucccaacuaacuuucuaggauuuuaaaacauaacacagugaaaacauacau aaacauaacucuacauuuuauuuaauucuuaaaguuuaaguguauuauacaagaagaagaguu uauauucgagagacagaaaaagucagaauuuuuguuuggaucaccaauauaucauagcuuaca aaaaaacugucuuaauuaaaacccacaacauaauuuuuuagauuuuuaagaaagauucuauu auucuucuuuauacuuaaaaauggaugauuccacucuuugcccacuuuuauuuuuauucacau agauuuucuuuauuucuauuagagaagcacuagaauucaugaauagugu ugauuuguuuc aagua auuaauucagaua aaagacauuucugcauguaugaaaauuucaauguga auuug cauauuuaauuaucaauccuucauuuaguguagacuuauuuuuaaaaaugcagguaaugaac cagaaauagaauugguugugcuagaguagagaaacuuuauuugaugauugu uuugaaaaaaa agcuucugagaagaaacaaccucuaguacaguauuaauucauuaagauagcuccuuuccucaga cauuccuuucaugu agccug aaaguucaauuug aaauuugu ucuuuccaauuuauucagac uaauucugccuacuuucuuccccccauaagaaccaauuacugcagcuuuauugagacugaaaa aaguuaauacaccuccuucuuuugcugaaccaaggaauggcuuggaacucuugggaaaagacaa ucuuuucuaugaucuuucauugucuaauuuaauacaucauaaauaugacuauagcuuugu au aauaaacuccccaauacugugccagaugu uuucuaagauaaaguuauuuuuaugu ucacaaaaa aaauaaaacuuuucucuggg ccaaaugu augccaacuuugcaaaucauauccug aagugcacu gcugcagaguacaugcuugcgucauaaauuccauagaguucgcuuuaacucuaaaucaauccc caguuucaaaguaaaccucucaaacauauuaccuaagcacaaacuucucccccugugcucaguuc cuuaauuauucuauccccauauucagaaauaacauuuaaaaauuaugcuuuugaucaauaaaua cuaaucuaaacuuugcuucauuaacccauucauuuuugucaaccauuauuuuauuccuauau ucaaagcucucugguauguucuuauauucaagacacucaaggcccuggaagauucacgaacau auguuugcaucuaaauuuuuagaaaaucuuucaaucugucaggauuacacugaacucuagu acagaguaauauggu uaccagaaagugg gagcaacucuuccacgu agacug g aaacagcacu aaaugcuauuuauaggcuacuuucugaacuuaacuuguuuuaaccucauuuuucucauaugc caaaugagaacgcaauacugaauuaucuguacaguucuguucaguacuagaauucugauucu ugaauucaaaggggaaaacauuccucuuuauuuuggagcuaaacugggggacaaaguuagg cuccaugaaagaagugcuauuugaacuaaagccuuuaagagggagaguauuucagaagagg agcuauuagacaaggaauuucaauguaaauggcaucucaaucaccuggcaauuauauuagcac acgguauuauauuaauugaagu ggcaug aaguau agaugaccagggaaguuaaaacuggaa auauagauuguggagugaugugaauaccaaggu aagaaaaauauuuguuaguuaccagagag ccaauaaauaacuuucaagugggacuuggg aaguuuaauuc aucuuacauagauuaaaugaa ggagaagguuaggagacagaugacagugcaaguauga aauaacagagggcaguucuaggu gg ugacuguguagaauggaaaagaggugg caaagcug agaaacguuucaaagaa aa aaugugagac agguaaugugaaaagaaaaucgagaaauaggguauagauaaucagug uucugcucauacucuaa auugggugu ugaaggcaaaaa acguauuuuuaauuaguacucuguguauacac acuagaaaca gcauguaaucuggauguggacaaaaauauuc ag aaaagaaggggaaauaguaacuugauuuc aauuccaaaucucuaaucugaaag aaaucuaauucuauucauccauuuaaaauaaauuauau aacgagaauuuaugaagu ccauugu auuaaug cagacagucagaug agauaaggcaaagugu cacgugucagc uuggu ag ugcaucgg ccacacauuuggu ucugccuggauaacucaacca aauuaauuuuuc auacucaucccuccaccuuugucauu acuggu auucuuauuuucuuugg cccacuuaucacacuguuuuaugu ucccc ag aaggccuagaguucuuuacaggcuuuaaacag ggaucagaaguauaagaaauugg cucaugu auuuuuuuuc ag acaggcaguuaaaaaaaau uguucuaaaaauacacuggcaucaaauggcaaauagaagaauguuuugacgacuacuuccauug gaucagacugacaagaauaauacaagcacauaggugg aauaaacuuagcuauuaaugu cca a guuugaggcagcug cccuu auaagcauuuaggg ucuguuuuuagcu ucccucuuagccac uccugugcagcuccaguggggaggu auggaggaaaaagcaaggaagccaucccuaugu uguuu ccaaacaugaacacucaagauuuuuaacuaguguguccagaaguaaagaggggggaaaacauccu ucuauagaaaaaaaaaaguagaauaaauuugaacacagaacucaugu ugaucacaucagau uugagaacuauguauggcaucccucuuuuucuuauuuuccuaagaaaugauuucuauuaugu uucauuugaaauaaguuuuugaauuaaacucagu aaaugaaac aacug acaugacuggagc uugaaauaaacgaug ug augaucuaaug aaauacauaaugcaaauugucuug cuucuuaugc aaaaauuauuagucauagcaaugcaugaauaauuaagacaaauuauuagguauuu aauaau auuuuuuauuuuaucaucugaauuuuaaguu auuaaaaauauauugg ucaaaucaacu caggu ccaaaugu uuuaguuuugu ucuuuaauauauugccuuuuu aaaaug aguu aaacuuc uguauaggcuuuuaacuuuucuuuaucugauaacacaauucug acuucaucuggcagcaa guuccucug auuuuccuuuuccuuuaaccuuuuaaugcuucucccuccccuuuuuuuaaaaa cauuuuug uuucauuucuug guuaauugcuuaaaugu cuaaaguguugucuuaa gaaaaaaaaug aauuuuaag auuuuuuug aaccuugcuuuuuacauaaccuag aauaaauagc auugauagaaaaaagaaug gaaagaccag agauuacuag ggg aauuuuuuucuuuauuaa cagauaagaauucugacuuuucuuuuuuuccauuugug uauu ag |
| SEQ ID NO. 9 | Exon 21 pre-mRNA | gauaaucuugcuccaacuuggauggggug gagcgcugguuccucccccugagcccuuuauuau gg |
| SEQ ID NO. 10 | Exon 20x pre-mRNA | GUGGUUGUGAAUGCCCUUUUAGGAGCAAUUCCAUCCAUCAU GAAUGUGCUUCUGGUUUGUCUUAUAUUCUGGCUAAUUUUCA GCAUCAUGGGCGUAAAUUUGUUUGCUGGCAAAUUCUACCAC UGUAUUAACACCACAACUGGUGACAGGUUUGACAUCGAAGA CGUGAAUAAUCAUACUGAUUGCCUAAAACUAAUAGAAGAA |

TABLE 3 -continued

Sequences of target exon or intron in SCN1A pre-mRNA transcripts.

| SEQ ID NO. | Sequence Type | Sequence |
|---|---|---|
| | | AUGAGACUGCUCGAUGGAAAAAUGUGAAAGUAAACUUUGAU<br>AAUGUAGGAUUUGGGUAUCUCUCUUUGCUUCAAGUU |
| SEQ ID NO. 17 | Exon 21 pre-mRNA | GUUUCAUUGGUCAGUUUAACAGCAAAUGCCUUGGGUUACUC<br>UGAACUCGGGGCCAUCAAAUCCCUAAGGACACUAAGAGCUCU<br>GAGACCCCUAAGAGCCUUAUCACGAUUUGAAGGGAUGAGG |
| SEQ ID NO. 18 | Intron 21 pre-mRNA | guaagaaaaaggaaaacucugcagcguuguauauugucaaagcuaggcugaguucaacuuaac<br>uaacgaaaaacacgugcaugcaaaaggaauggcaacccuuugcaaacuugcuacuuuacccuu<br>uucucuguugcauauuuacuucuuggugauaugcaagagaaaaucggccucuuugaaauga<br>uuuaauaucauuuacucgcuuugcuaauuaaaaugaccuuaguucauaacgaucuugggag<br>uuuccuuauaauuccuaauacaaaggggggagggcagauacucucuuaaagaacuaaguuga<br>gucauguaauaauuaccuagagauaauuuuguuucauaucguucuccucuaugacagcc cau<br>caguacuuaagggauccuuaggaaaguaaugugaaucacaaaugugauagaauacaaaggaaa<br>aaaugaagaauuguuaaaugauuuugucuuuacaaugccaaaauucucauuauuugaauauau<br>ccaagggcagauauuaaccauugacuggaguauaauaaaucugccucaacuguaacuaaauua<br>augacauugaauaaguaagacacuaauuuaauuacuauaaauacauacacaucuuaugacaau<br>acagcugauaaggaaaaagaacauguauuuuauucauugccauacauggcucgucaaccuua<br>acuuaaaccucgguucucaguuacacagaguuuuauguugcucuuuugagcaaagcauuauu<br>cccucuccauaauucaacacguaucagauuuuugcauuuauuggcucauuguuuaugaugau<br>uauuucaaagcauuaucaaucauuuauagaagaugugccgugugaaaauuauuuuuuauu<br>aagauccaaaauuuacgcucuuuaaaccaaucagaugaaaugauaaggcaaagagugcucau<br>uguccugacacuuacaaaccaaggcuccaacaaacaggcuccucucugcaccacauagagggcu<br>uucagccugugucccccauaauauaaauuuuuauuauacuauacuguaagaaacc<br>uguccaauuuuuaauuucucuagcacauaugaaaacuuucucuucaguagauccaaguaagcac<br>aaaggagcuuugauucucacacaagaaaucacauuuguauuaaaaauguaucauaaauuucu<br>cccaauuaugcaaaacuuaaaugcuuuuccaauuaaaagagcacuuucguuucagaauagcaa<br>uuucaguugucaaggaaaacauuguuuuuauacauuuuauauaaaaauacaugagcuaaauu<br>uaaauucacauuuucaacuuuuuauggguuuuuuauguuucuuuuucuuucgcauuuuuu<br>aacaauccagccauuaccucuccuccccuguccccccuccuauaguuucucaucucauuccuccu<br>cccccuugccucugagaggaugcucccuccccucacuaggccucccucuuccccagggcuucaa<br>guuccucaaggauuauacacaucuucucccacugagaccaggccaggcagcccucugcuucug<br>cccagccuguguauguuccugcuuggguagcucagucucuggaagcucccugggggucugggu<br>uaguugggacugcugguucuuccuaggaguuacccuccccuucaacuucuucaauccuuccc<br>cuaauucaaccacagguauccagacuucagucccaauggguugaguguaaauauuggcaucugu<br>cucugucagcuguugauagggggcucagaggacagccaugcuaggcuccugccuacaagcagc<br>acaccauaacaucaguaauaguguugcagggcuuuaaugaauaaugucaacguauaauaaagguugu<br>uagauuauacuucaacuuuugaucuuuuagaauauuauuaaauccagucguuuauuuuuauaa<br>uguaauauugacuuuccauaacaaaugagcucuauuuccuuuuguguagaaauaacuuuauc<br>aauuauuguuaauaaugcuuuugucaauuauuguugauaugcuucucuuuuuuaaaacugg<br>agucaucaaaacaaaaauucggguagauauuuacgaagcugacuccuuggucagcuuggcaca<br>uagugagaccacaaauaucucaaggucacggcaauuccucaccaccaguuuggcauugugaag<br>ucaaaaccaaccuucuguugauucgguuuuuguauuucuaguaugagacauuuuucuacuuu<br>guaagaguauaauacuguggauggcggcgagguugggcaugaugaugauuguaagcgggaa<br>gugagcuagaguauccuucagaaacucucacuuuuaucuccuccuggcagcauagaaccgcaaucg<br>cuguguccgagugucaaccaggcagucauuuuguuugggguuuuuugucacucuuucaaag<br>caugugcuuacgcaacacuaccaaacacagcaugcugcauagugcuugagaaggaguuaga<br>aaguaacaaacgaguuaucaucacguugcccuuuguguuuugcaugucuuaugcacacuuuu<br>ggcugacagcuuuugaacauuuaauuguauuucaaauuuccaguccaaauuuuuuuuucaacu<br>ugugaaauugaacggaaugaaccgaugucgugaauaccuagggucaaauaaaacuuguauuu<br>aaauucguaguuuaauuucccaagcugggaaaaacguaaaaaccuuuuccaaagaacucaag<br>ucuuaguugcuagggaaacaggcagugagcaucauauacaaaaaguaacaccaaauguuucugu<br>cauaucagcuuuuucuaacuaauaauaaacuauauauuucuauuuuauauaggauaaucuugcu<br>ccaacuuggaugggguggagcgguggguuccuccccucagcccuuuauuauugggguacuguauu<br>accccuuuugcuaccuuuaauccuugcacugugacuuaugguguaguggauugagggaggga<br>gugggaagggucaauugcaccacaguagggacaauacaggauuuauuuccaaauccacuacu<br>uuuaaugagcuuaaacuucuuuugggaaaaaaaaguuaucucugacuuaccaucuguggau<br>uauaaccccagaaguacauaucuuuauuacguuucacugauauagauuuuagcuauuuauacu<br>ucauugccauuuaugggggaaauuacucaauuggugagggguggggggacccuggguuaggau<br>gcugaugaaaacguuucauuugucaagcuauggaguagugacagagcauauagucccuauuu<br>uuucaacacacugcucugguccccucaaugggccagucacauuccaucaguugaucguugaug<br>ugugcgagcaguggcuaaagguacaacaggccagguaucucaggguugccaauggguuaugau<br>cauucucaucuuuauugcauaaaaaugguguuauuugcagaaaguagcaaggcaagauccug<br>ugaaacaaggaauacaaaaaaaaaaaagaugugcuuuaaguuuuaaaaccaaaacaugugaa<br>aagucaacuucauugaaguauaaaagaauaggauaugcaugaaaaacaaaaaaaaucaugagcac<br>uaagaaauuguguauaagccaacuccuuguaagcuaccccaauuaacuuucccagaaucuuag<br>aaggcaucacagugcaccccaaaauaaaaagccaaacugacacuucugcuuccucuuuaaauguu<br>aggagucuuggauaaagaauaauuuuuauguguuggaagaaaaaaaauguuuggauaa<br>uugaggcauuuaucuaucaaaaauauuuuaucuuaauaaauuucacaacacugauuuaguug<br>uuggcuuuucaaaaauucuuaaagaacaugaacucaugauuuuuacuuuccauu<br>uuuaaauucuuauucacauauggguuuuucucuauuucuugaaaagcuauagaacccauggu<br>uuccggugacuuaaaaaacuaaucaaaugucuucacuuugaugauacuuucaaaugcacuga<br>aauuucuaauaucaacaagaauauuugccgguccuaauuuucacugauuuaauaaaagua<br>ugaacccuaaagaagaaaugacuugaagaacgguugugugacaauacagaaauucucgg<br>gagaugguccuuuuaaaaacauuguuagaagagacaaccucuacaauccacccauuaagcauacu |

TABLE 3 -continued

Sequences of target exon or intron in SCN1A pre-mRNA transcripts.

| SEQ ID NO. | Sequence Type | Sequence |
|---|---|---|
| | | ucucucuuagacaucuccuuuuauguaccuuauaaccucaauguguucuuuccaauugacuu<br>agaccaacacuucccagcgcaucccacaugggagccaauuacugacucucccuagagacugcaa<br>agaauuaauauuguagaaccaagggauggutugggcucuugggagaggcaauccguuugugau<br>cuuuugcucuggauguuaaugaaaucgcaacuuuaaguggauuuucaguggcaaauccucug<br>auccuaugccaaaauguucucuaagacaaacauccuuguaaaauaaaugucucacugggccaaa<br>ucuauggcaaauuugcacguuuccugaacugcauccuauauaguauuugccauccugaau<br>ucacuaaugggcauuacuuuuaauucaaaaccaguccccuucuucaaaggaaaucucucccauu<br>uauuacauuaugcaaacugcuuucuuaugcaguggutuaaaaccuuagccaggcaaguaugag<br>gacuggaauuuggauauccagaacccucagaaaugucggaugggcauaguagcuuacaugua<br>auuccagagcuagaaagaugaaacuagcccuguccucaagcucugaauucaguuggugcaaua<br>aauaagaaagaaucccccccccgaccccuacaucucuuuccucuacaucuauacauguauuuc<br>ccauacagcucuaugcuuccacauauaugcacauaugcaugcacacauugcacacauaug<br>uacacuugacacauuugaagcaucauaaucuaacaauuggaauauaagaaaaauauuuaacuuuc<br>acacagagcagucagagaaaaccauaagaggutugaaacucuugaaaaaacuugcaggauaaaca<br>gaaaagaguaugagaugccaauucggucuacuuucugaaccuaacuuguuuuaccuucauu<br>agucuaauuuccaaaugaaccccaagcaccaaauugccuuaaugcucuuuccaguacuaaa<br>uuauaauuccucaauucgaaggcaaacacucucaucuuuguuaaggaugguguagaguugac<br>ucaauaaacgacauguauauuugagcuaaagccuggaggagggagauuauuucaagggcaag<br>uacuuggcagggaguuucaaagaaagaaggcucucaauucucagacuaacaccuuagcgugga<br>gugacugucacagaggagggugaaguguaaugucaccaguuagggaagcugaaagggaaaug<br>uaucaggcuugugagaauccuucagcagccaagucuagcaccugagcacaaucccagaacug<br>accccacaugguggaaaggagaggaauaauuccugcaaauuuuccugugaccuccacccaagu<br>gcuauagaaaaugcaugcaugcccacaugcacacacaaauaaacauaguugcaaacuguuuug<br>aggaaaauaaccucacaaacugucgaguguauaaugccaaagaaagagaaaauguuuucuaa<br>uggcuagagaaccauuaaggaauuuucaaaaugggacauggganuagauaaauuuaguaucc<br>auacugaaagaaggcaagcaaauaaaaucugauaagaaugaaaucuuaguaaccgaggacag<br>agcgaagauagagaacagggccaauggccaaggaggugaaaggauuugaaggaagcagcaugaaac<br>cuacagacuuguaccaaaauguucagugucaugagauguuaaaagugaaaagcuugcauguua<br>guauggauuucauauccucggcagacagagcaccucacugugagugggagaugaaguauuca<br>gaaaugagaaacaacuacucaauuucaguguucauaucucaaauccaauaaacaacuuuaggg<br>guacaauuuuuaaaaaauuacauuaaaaaguuuuuaaaucucuucuuaauaauuuaaaaau<br>uaaaauugaaaauaacuuuaaaaguaauauauacaggaaagccugugugcuaauuuuuagg<br>gaggccauaaagggagauaguugcucauuaauuucuacacaucagccuaucuuuggcuucug<br>ccuugauagcgcacucugaauuaucuuucuucauguucaucccucaucuuuauuguuacuggu<br>uucauuccccuuggccacauagcccacuauuuuguauucccaauggauauuguuccuuaca<br>aaguucagccagggcucagaaguacaaggaauuggcucuuuauacuucugucagacaggcaaaa<br>acuucuaaaauuauacuauaauaaaaaucaaagagaugauaauucaaaauuaaacuaacaaaagu<br>ggcaggccccccucccccaacaugaguagaauuaaucugacguccaguucaagucugaaac<br>acacuugccaauuaagagcacauuagggccagccuuuaucucccucuuaguuacuaaugugca<br>guucaauggugagcuauagagaaggaagccaagacuaccauaugucaaauauaaaaaaaaaa<br>aucccauuuuaaaucuguaguccгaauuaaggacaagagagagggaaauaucuuugacauua<br>gaaaaauggagaaaauauuuuagcacaggacuuuacucagucacaucagaguugauaaguacgu<br>augacaucccucuuuuuccuguuuuccugagaaaaugaucuccuaguguuucauuuaagau<br>aaguuuauuggaauuaaacucaguaaaugaaacaacugacaugacuggagcuugaaauaaacga<br>ugugaugaucuacugaaaaucaugaugcuaaauugcuugcuucuuaugcaaaaacuacuau<br>uaguuauagcaaugcauggauaauuaaggccaaaaauauauuagauguuaaaaauaguuuua<br>uauuuauacaucugaauuuuaauuuauauuuaaaguauauuggccaaucaauucaugccca<br>aaugututuaguucuauucuuuggagauacuguuuuguuuugggauuuuuuuuugaugcuaa<br>ucucuugccuaggaguuccuacuucucucuccuccuuuuauuuuuucuaauaaacuacacau<br>gugucuuccuccaggagcuaacuucucccauuuugcuuuccuuuagcaccuuuuuaauauu<br>agauuucuuucuuuucuccaucucuuugcauauugccuauauuucuuuuccuaagcauaaua<br>uuuaaaaagacugaguuuuaugunaagauuauuucugcuuugcucuuuacacagauaggaua<br>aguagucuugauagaaaauaaaucaaugauuccuaggggaugucuuuuugcuuuuaaucaa<br>uaaggauucugacuucucuuucucuccauuuguguauuag |
| SEQ ID NO. 19 | Exon 22 pre-mRNA | gauaaucuugcuccaacuuggauggggguggagcggugguuccucccccucagcccuuuauuau<br>gg |
| SEQ ID NO. 20 | Exon 21x pre-mRNA | GUGGUUGUGAAUGCCCUGUUAGGAGCAAUUCCAUCCAUCAU<br>GAAUGUGCUUCUGGUUUGCCUUAUAUUCUGGCUAAUUUUCA<br>GCAUCAUGGGCGUAAAUUUGUUUGCUGGCAAAUUCUACCAC<br>UGUGUUAACACCACAACUGGUGACAUAUUUGAGAUCAGCGA<br>AGUCAAUAAUCAUUCUGAUUGCCUAAAACUAAUAGAAAGAA<br>AUGAGACCGCCCGGUGGAAAAAUGUGAAAGUAAACUUUGAU<br>AAUGUAGGAUUUGGGUAUCUUUCUUUGCUUCAAGUU |

Example 2: Confirmation of NIE Via Cycloheximide Treatment

RT-PCR analysis using cytoplasmic RNA from DMSO-treated (CHX−) or cycloheximide-treated (CHX+) mouse Neuro 2A cells (FIG. 3A) and RenCell VM (human neuro-progenitor cells) (FIG. 3B) and primers in exon 20 and exon 23 confirmed the presence of a band corresponding to the NMD-inducing exon (20x). The identity of the product was confirmed by sequencing. Densitometry analysis of the bands was performed to calculate percent exon 20x inclusion of total SCN1A transcript. Treatment of RenCell VM with cycloheximide (CHX+) to inhibit NMD led to a 2-fold increase of the product corresponding to the NMD-inducing exon 20x in the cytoplasmic fraction (cf. light grey bar, CHX−, to dark grey bar, CHX+).

Example 3: SCN1A Exon 20x Region ASO Walk

Figure 4:
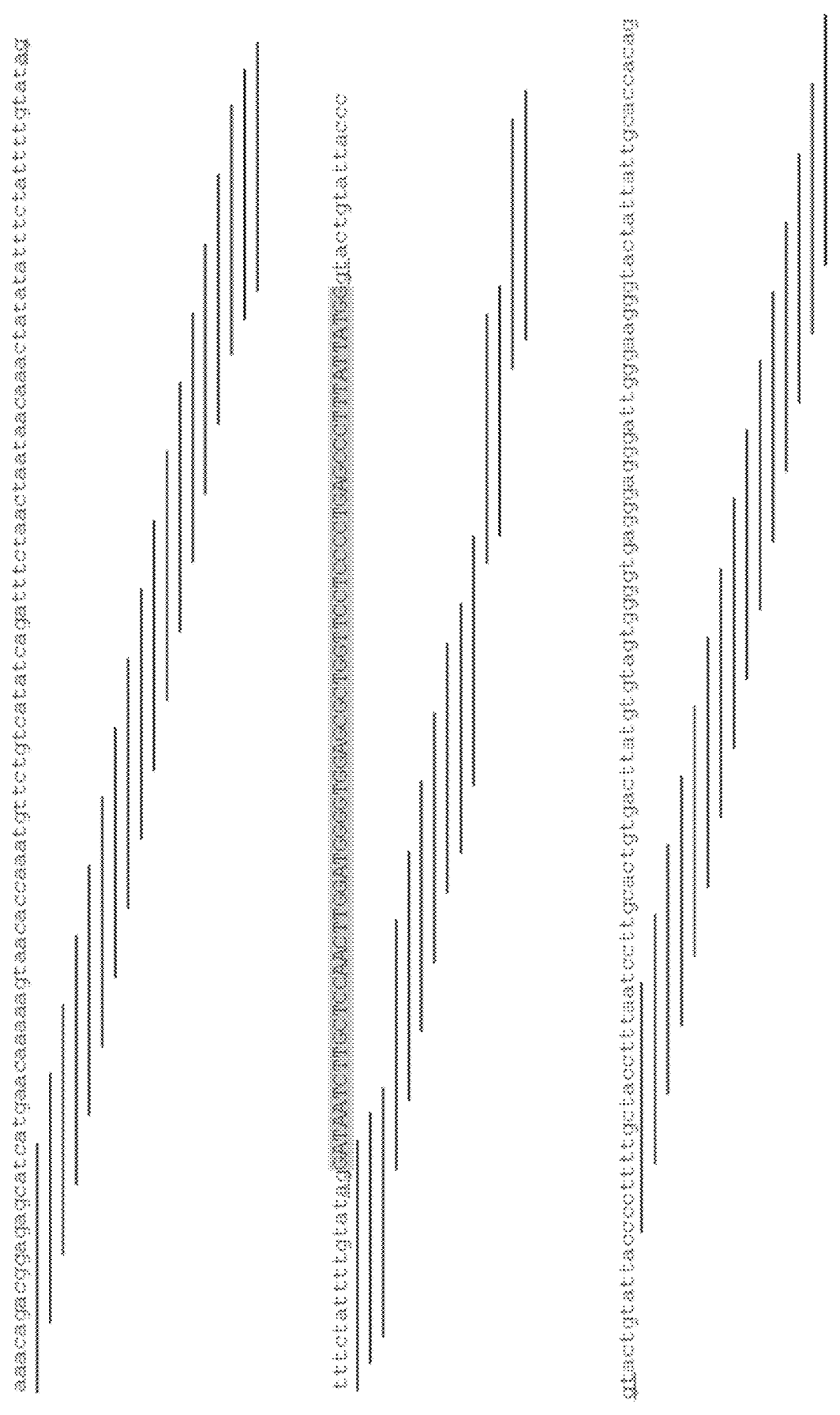

A graphic representation of the ASO walk performed for SCN1A exon 20x region targeting sequences immediately upstream of the 3' splice site, across the 3'splice site, exon 20x, across the 5' splice site, and downstream of the 5' splice site using 2'-MOE ASOs, PS backbone, is shown in FIG. 4. ASOs were designed to cover these regions by shifting 5 nucleotides at a time. A list of ASOs targeting SCN1A is summarized in Table 4. Sequences of ASOs are summarized in Table 5a and Table 5b and Table 6a and Table 6b.

TABLE 4

List of ASOs targeting SCN1A

| Gene SEQ ID NO. | Pre-mRNA SEQ ID NO. | ASOs SEQ ID NO. | NIE |
|---|---|---|---|
| SEQ ID NO. 1 | SEQ ID NO. 2 | SEQ ID NOs: 21-67, 210-256 | Exon 20x |
| SEQ ID NO. 11 | SEQ ID NO. 12 | SEQ ID NOs: 68-114, 257-303 | Exon 21x |

TABLE 5

Sequences of ASOs targeting human SCN1A

| SEQ ID NO. | Sequence name | ASO sequence |
|---|---|---|
| 21 | SCN1A-IVS19X-81 | GATGCTCTCCGTCTGTTT |
| 22 | SCN1A-IVS19X-76 | TTCATGATGCTCTCCGTC |
| 23 | SCN1A-IVS19X-71 | TTTTGTTCATGATGCTCT |
| 24 | SCN1A-IVS19X-66 | TTACTTTTGTTCATGAT |
| 25 | SCN1A-IVS19X-61 | TGGTGTTACTTTTGTTC |
| 26 | SCN1A-IVS19X-56 | ACATTTGGTGTTACTTTT |
| 27 | SCN1A-IVS19X-51 | ACAGAACATTTGGTGTTA |
| 28 | SCN1A-IVS19X-46 | ATATGACAGAACATTTGG |
| 29 | SCN1A-IVS19X-41 | ATCTGATATGACAGAACA |
| 30 | SCN1A-IVS19X-36 | TAGAAATCTGATATGACA |
| 31 | SCN1A-IVS19X-31 | TTAGTTAGAAATCTGATA |
| 32 | SCN1A-IVS19X-26 | TGTTATTAGTTAGAAATC |
| 33 | SCN1A-IVS19X-21 | TAGTTTGTTATTAGTTAG |
| 34 | SCN1A-IVS19X-16 | ATATATAGTTTGTTATTA |
| 35 | SCN1A-IVS19X-11 | TAGAAATATATAGTTTGT |
| 36 | SCN1A-IVS19X-6 | CAAAATAGAAATATATAG |
| 37 | SCN1A-IVS19X-3 | ATACAAAATAGAAATATA |
| 38 | SCN1A-IVS19X-1 | CTATACAAAATAGAAATA |
| 39 | SCN1A-I19X/E20X+2 | TCCTATACAAAATAGAAA |

TABLE 5 -continued

Sequences of ASOs targeting human SCN1A

| SEQ ID NO. | Sequence name | ASO sequence |
|---|---|---|
| 40 | SCN1A-I19X/E20X+4 | TATCCTATACAAAATAGA |
| 41 | SCN1A-I19X/E20X+6 | ATTATCCTATACAAAATA |
| 42 | SCN1A-Ex20X+1 | AGTTGGAGCAAGATTATC |
| 43 | SCN1A-Ex20X+6 | ATCCAAGTTGGAGCAAGA |
| 44 | SCN1A-Ex20X+11 | ACCCCATCCAAGTTGGAG |
| 45 | SCN1A-Ex20X+16 | GCTCCACCCCATCCAAGT |
| 46 | SCN1A-Ex20X+21 | CCAGCGCTCCACCCCATC |
| 47 | SCN1A-Ex20X-24 | GAACCAGCGCTCCACCCC |
| 48 | SCN1A-Ex20X-19 | GGGAGGAACCAGCGCTCC |
| 49 | SCN1A-Ex20X-3 | ATAATAAAGGGCTCAGGG |
| 50 | SCN1A-Ex20X-1 | CCATAATAAAGGGCTCAG |
| 51 | SCN1A-E20X/I20X-6 | GTAATACAGTACCCATAA |
| 52 | SCN1A-E20X/I20X-4 | GGGTAATACAGTACCCAT |
| 53 | SCN1A-IVS20X+13 | TTAAAGGTAGCAAAAGGG |
| 54 | SCN1A-IVS20X+18 | AAGGATTAAAGGTAGCAA |
| 55 | SCN1A-IVS20X+23 | AGTGCAAGGATTAAAGGT |
| 56 | SCN1A-IVS20X+28 | GTCACAGTGCAAGGATTA |
| 57 | SCN1A-IVS20X+33 | CATAAGTCACAGTGCAAG |
| 58 | SCN1A-IVS20X+38 | CTACACATAAGTCACAGT |
| 59 | SCN1A-IVS20X+43 | CCCCACTACACATAAGTC |
| 60 | SCN1A-IVS20X+48 | CCTCACCCCACTACACAT |
| 61 | SCN1A-IVS20X+53 | CCCTCCCTCACCCCACTA |
| 62 | SCN1A-IVS20X+58 | CCAATCCCTCCCTCACCC |
| 63 | SCN1A-IVS20X+63 | CCTTCCCAATCCCTCCCT |
| 64 | SCN1A-IVS20X+68 | AGTACCCTTCCCAATCCC |
| 65 | SCN1A-IVS20X+73 | ATAATAGTACCCTTCCCA |
| 66 | SCN1A-IVS20X+78 | GTGCAATAATAGTACCCT |
| 67 | SCN1A-IVS20X+83 | CTGTGGTGCAATAATAGT |

TABLE 5b

Sequences of ASOs targeting human SCN1A

| SEQ ID NO. | Sequence name | ASO sequence |
|---|---|---|
| 210 | SCN1A-IVS19X-81 | GAUGCUCUCCGUCUGUUU |
| 211 | SCN1A-IVS19X-76 | UUCAUGAUGCUCUCCGUC |
| 212 | SCN1A-IVS19X-71 | UUUUGUUCAUGAUGCUCU |
| 213 | SCN1A-IVS19X-66 | UUACUUUUGUUCAUGAU |
| 214 | SCN1A-IVS19X-61 | UGGUGUUACUUUUGUUC |
| 215 | SCN1A-IVS19X-56 | ACAUUUGGUGUUACUUUU |

TABLE 5b-continued

Sequences of ASOs targeting human SCN1A

| SEQ ID NO. | Sequence name | ASO sequence |
|---|---|---|
| 216 | SCN1A-IVS19X-51 | ACAGAACAUUUGGUGUUA |
| 217 | SCN1A-IVS19X-46 | AUAUGACAGAACAUUUGG |
| 218 | SCN1A-IVS19X-41 | AUCUGAUAUGACAGAACA |
| 219 | SCN1A-IVS19X-36 | UAGAAAUCUGAUAUGACA |
| 220 | SCN1A-IVS19X-31 | UUAGUUAGAAAUCUGAUA |
| 221 | SCN1A-IVS19X-26 | UGUUAUUAGUUAGAAAUC |
| 222 | SCN1A-IVS19X-21 | UAGUUUGUUAUUAGUUAG |
| 223 | SCN1A-IVS19X-16 | AUAUAUAGUUUGUUAUUA |
| 224 | SCN1A-IVS19X-11 | UAGAAAUAUAUAGUUUGU |
| 225 | SCN1A-IVS19X-6 | CAAAAUAGAAAUAUAUAG |
| 226 | SCN1A-IVS19X-3 | AUACAAAAUAGAAAUAUA |
| 227 | SCN1A-IVS19X-1 | CUAUACAAAAUAGAAAUA |
| 228 | SCN1A-I19X/E20X+2 | UCCUAUACAAAAUAGAAA |
| 229 | SCN1A-I19X/E20X+4 | UAUCCUAUACAAAAUAGA |
| 230 | SCN1A-I19X/E20X+6 | AUUAUCCUAUACAAAAUA |
| 231 | SCN1A-Ex20X+1 | AGUUGGAGCAAGAUUAUC |
| 232 | SCN1A-Ex20X+6 | AUCCAAGUUGGAGCAAGA |
| 233 | SCN1A-Ex20X+11 | ACCCCAUCCAAGUUGGAG |
| 234 | SCN1A-Ex20X+16 | GCUCCACCCCAUCCAAGU |
| 235 | SCN1A-Ex20X+21 | CCAGCGCUCCACCCCAUC |
| 236 | SCN1A-Ex20X-24 | GAACCAGCGCUCCACCCC |
| 237 | SCN1A-Ex20X-19 | GGGAGGAACCAGCGCUCC |
| 238 | SCN1A-Ex20X-3 | AUAAUAAAGGGCUCAGGG |
| 239 | SCN1A-Ex20X-1 | CCAUAAUAAAGGGCUCAG |
| 240 | SCN1A-E20X/I20X-6 | GUAAUACAGUACCCAUAA |
| 241 | SCN1A-E20X/I20X-4 | GGGUAAUACAGUACCCAU |
| 242 | SCN1A-IVS20X+13 | UUAAAGGUAGCAAAAGGG |
| 243 | SCN1A-IVS20X+18 | AAGGAUUAAAGGUAGCAA |
| 244 | SCN1A-IVS20X+23 | AGUGCAAGGAUUAAAGGU |
| 245 | SCN1A-IVS20X+28 | GUCACAGUGCAAGGAUUA |
| 246 | SCN1A-IVS20X+33 | CAUAAGUCACAGUGCAAG |
| 247 | SCN1A-IVS20X+38 | CUACACAUAAGUCACAGU |
| 248 | SCN1A-IVS20X+43 | CCCCACUACACAUAAGUC |
| 249 | SCN1A-IVS20X+48 | CCUCACCCCACUACACAU |
| 250 | SCN1A-IVS20X+53 | CCCUCCCUCACCCCACUA |
| 251 | SCN1A-IVS20X+58 | CCAAUCCUCCCUCACCC |
| 252 | SCN1A-IVS20X+63 | CCUUCCCAAUCCUCCCU |
| 253 | SCN1A-IVS20X+68 | AGUACCCUUCCCAAUCCC |

TABLE 5b-continued

Sequences of ASOs targeting human SCN1A

| SEQ ID NO. | Sequence name | ASO sequence |
|---|---|---|
| 254 | SCN1A-IVS20X+73 | AUAAUAGUACCCUUCCCA |
| 255 | SCN1A-IVS20X+78 | GUGCAAUAAUAGUACCCU |
| 256 | SCN1A-IVS20X+83 | CUGUGGUGCAAUAAUAGU |

TABLE 6a

Sequences of ASOs targeting mouse SCN1A

| SEQ ID NO. | Sequence name | ASO sequence |
|---|---|---|
| 68 | mScn1a-IVS20X-81 | GATGCTCACTGCCTGTTT |
| 69 | mScn1a-IVS20X-76 | TATATGATGCTCACTGCC |
| 70 | mScn1a-IVS20X-71 | TTTTGTATATGATGCTCA |
| 71 | mScn1a-IVS20X-66 | TTACTTTTGTATATGAT |
| 72 | mScn1a-IVS20X-61 | TGGTGTTACTTTTGTAT |
| 73 | mScn1a-IVS20X-56 | ACATTTGGTGTTACTTTT |
| 74 | mScn1a-IVS20X-51 | ACAGAACATTTGGTGTTA |
| 75 | mScn1a-IVS20X-46 | ATATGACAGAACATTTGG |
| 76 | mScn1a-IVS20X-41 | AGCTGATATGACAGAACA |
| 77 | mScn1a-IVS20X-36 | TAGAAAGCTGATATGACA |
| 78 | mScn1a-IVS20X-31 | TTAGTTAGAAAGCTGATA |
| 79 | mScn1a-IVS20X-26 | TATTATTAGTTAGAAAGC |
| 80 | mScn1a-IVS20X-21 | TAGTTTATTATTAGTTAG |
| 81 | mScn1a-IVS20X-16 | ATATATAGTTTATTATTA |
| 82 | mScn1a-IVS20X-11 | TAGAAATATATAGTTTAT |
| 83 | mScn1a-IVS20X-6 | TAAAATAGAAATATATAG |
| 84 | mScn1a-IVS20X-3 | ATATAAAATAGAAATATA |
| 85 | mScn1a-IVS20X-1 | CTATATAAAATAGAAATA |
| 86 | mScn1a-I20X/E21X+2 | TCCTATATAAAATAGAAA |
| 87 | mScn1a-I20X/E21X+4 | TATCCTATATAAAATAGA |
| 88 | mScn1a-I20X/E21X+6 | ATTATCCTATATAAAATA |
| 89 | mScn1a-Ex21X+1 | AGTTGGAGCAAGATTATC |
| 90 | mScn1a-Ex21X+6 | ATCCAAGTTGGAGCAAGA |
| 91 | mScn1a-Ex21X+11 | ACCCCATCCAAGTTGGAG |
| 92 | mScn1a-Ex21X+16 | GCTCCACCCCATCCAAGT |
| 93 | mScn1a-Ex21X+21 | CCACCGCTCCACCCCATC |
| 94 | mScn1a-Ex21X-24 | GAACCACCGCTCCACCCC |
| 95 | mScn1a-Ex21X-19 | GGGAGGAACCACCGCTCC |
| 96 | mScn1a-Ex21X-3 | ATAATAAAGGGCTGAGGG |
| 97 | mScn1a-Ex21X-1 | CCATAATAAAGGGCTGAG |

TABLE 6a-continued

Sequences of ASOs targeting mouse SCN1A

| SEQ ID NO. | Sequence name | ASO sequence |
| --- | --- | --- |
| 98 | mScn1a-E21X/I21X-6 | GTAATACAGTACCCATAA |
| 99 | mScn1a-E21X/I21X-4 | GGGTAATACAGTACCCAT |
| 100 | mScn1a-IVS21X+13 | TTAAAGGTAGCAAAAGGG |
| 101 | mScn1a-IVS21X+18 | AAGGATTAAAGGTAGCAA |
| 102 | mScn1a-IVS21X+23 | AGTGCAAGGATTAAAGGT |
| 103 | mScn1a-IVS21X+28 | GTCACAGTGCAAGGATTA |
| 104 | mScn1a-IVS21X+33 | CATAAGTCACAGTGCAAG |
| 105 | mScn1a-IVS21X+38 | CTACACATAAGTCACAGT |
| 106 | mScn1a-IVS21X+43 | TCCCACTACACATAAGTC |
| 107 | mScn1a-IVS21X+48 | CTCAATCCCACTACACAT |
| 108 | mScn1a-IVS21X+53 | CCTCCCTCAATCCCACTA |
| 109 | mScn1a-IVS21X+58 | CACTCCCTCCCTCAATCC |
| 110 | mScn1a-IVS21X+63 | CTTCCCACTCCCTCCCTC |
| 111 | mScn1a-IVS21X+68 | GTACCCTTCCCACTCCCT |
| 112 | mScn1a-IVS21X+73 | CAATTGTACCCTTCCCAC |
| 113 | mScn1a-IVS21X+78 | TGGTGCAATTGTACCCTT |
| 114 | mScn1a-IVS21X+83 | TACTGTGGTGCAATTGTA |

TABLE 6b

Sequences of ASOs targeting mouse SCN1A

| SEQ ID NO. | Sequence name | ASO sequence |
| --- | --- | --- |
| 257 | mScn1a-IVS20X-81 | GAUGCUCACUGCCUGUUU |
| 258 | mScn1a-IVS20X-76 | UAUAUGAUGCUCACUGCC |
| 259 | mScn1a-IVS20X-71 | UUUUGUAUAUGAUGCUCA |
| 260 | mScn1a-IVS20X-66 | UUACUUUUGUAUAUGAU |
| 261 | mScn1a-IVS20X-61 | UGGUGUUACUUUUGUAU |
| 262 | mScn1a-IVS20X-56 | ACAUUGGUGUUACUUUU |
| 263 | mScn1a-IVS20X-51 | ACAGAACAUUGGUGUUA |
| 264 | mScn1a-IVS20X-46 | AUAUGACAGAACAUUGG |
| 265 | mScn1a-IVS20X-41 | AGCUGAUAUGACAGAACA |
| 266 | mScn1a-IVS20X-36 | UAGAAAGCUGAUAUGACA |
| 267 | mScn1a-IVS20X-31 | UUAGUUAGAAAGCUGAUA |
| 268 | mScn1a-IVS20X-26 | UAUUAUUAGUUAGAAAGC |
| 269 | mScn1a-IVS20X-21 | UAGUUUAUUAUUAGUUAG |
| 270 | mScn1a-IVS20X-16 | AUAUAUAGUUUAUUAUUA |
| 271 | mScn1a-IVS20X-11 | UAGAAAUAUAUAGUUUAU |
| 272 | mScn1a-IVS20X-6 | UAAAAUAGAAAUAUAUAG |
| 273 | mScn1a-IVS20X-3 | AUAUAAAAUAGAAAUAUA |

TABLE 6b-continued

Sequences of ASOs targeting mouse SCN1A

| SEQ ID NO. | Sequence name | ASO sequence |
| --- | --- | --- |
| 274 | mScn1a-IVS20X-1 | CUAUAUAAAAUAGAAAUA |
| 275 | mScn1a-I20X/E21X+2 | UCCUAUAUAAAAUAGAAA |
| 276 | mScn1a-I20X/E21X+4 | UAUCCUAUAUAAAAUAGA |
| 277 | mScn1a-I20X/E21X+6 | AUUAUCCUAUAUAAAAUA |
| 278 | mScn1a-Ex21X+1 | AGUUGGAGCAAGAUUAUC |
| 279 | mScn1a-Ex21X+6 | AUCCAAGUUGGAGCAAGA |
| 280 | mScn1aEx21X+11 | ACCCCAUCCAAGUUGGAG |
| 281 | mScn1a-Ex21X+16 | GCUCCACCCCAUCCAAGU |
| 282 | mScn1a-Ex21X+21 | CCACCGCUCCACCCCAUC |
| 283 | mScn1a-Ex21X-24 | GAACCACCGCUCCACCCC |
| 284 | mScn1a-Ex21X-19 | GGGAGGAACCACCGCUCC |
| 285 | mScn1a-Ex21X-3 | AUAAUAAAGGGCUGAGGG |
| 286 | mScn1a-Ex21X-1 | CCAUAAUAAAGGGCUGAG |
| 287 | mScn1a-E21X/I21X-6 | GUAAUACAGUACCCAUAA |
| 288 | mScn1a-E1X/I21X-4 | GGGUAAUACAGUACCAU |
| 289 | mScn1a-IVS21X+13 | UUAAAGGUAGCAAAAGGG |
| 290 | mScn1a-IVS21X+18 | AAGGAUUAAAGGUAGCAA |
| 291 | mScn1a-IVS21X+23 | AGUGCAAGGAUUAAAGGU |
| 292 | mScn1a-I21X+28 | GUCACAGUGCAAGGAUUA |
| 293 | mScn1a-IVS21X+33 | CAUAAGUCACAGUGCAAG |
| 294 | mScn1a-IVS21X+38 | CUACACAUAAGUCACAGU |
| 295 | mScn1a-IVS21X+43 | UCCCACUACACAUAAGUC |
| 296 | mScn1a-IVS21X+48 | CUCAAUCCCACUACACAU |
| 297 | mScn1a-IVS21X+53 | CCUCCCUCAAUCCCACUA |
| 298 | mScn1a-IVS21X+58 | CACUCCCUCCCUCAAUCC |
| 299 | mScn1a-IVS21X+63 | CUUCCCACUCCCUCCCUC |
| 300 | mScn1a-IVS21X+68 | GUACCCUUCCCACUCCCU |
| 301 | mScn1a-IVS21X+73 | CAAUUGUACCCUUCCCAC |
| 302 | mScn1a-IVS21X+78 | UGGUGCAAUUGUACCCUU |
| 303 | mScn1a-IVS21X+83 | UACUGUGGUGCAAUUGUA |

Example 4: SCN1A Exon 20x Region ASO Walk Evaluated by RT-PCR

Figure 5A:
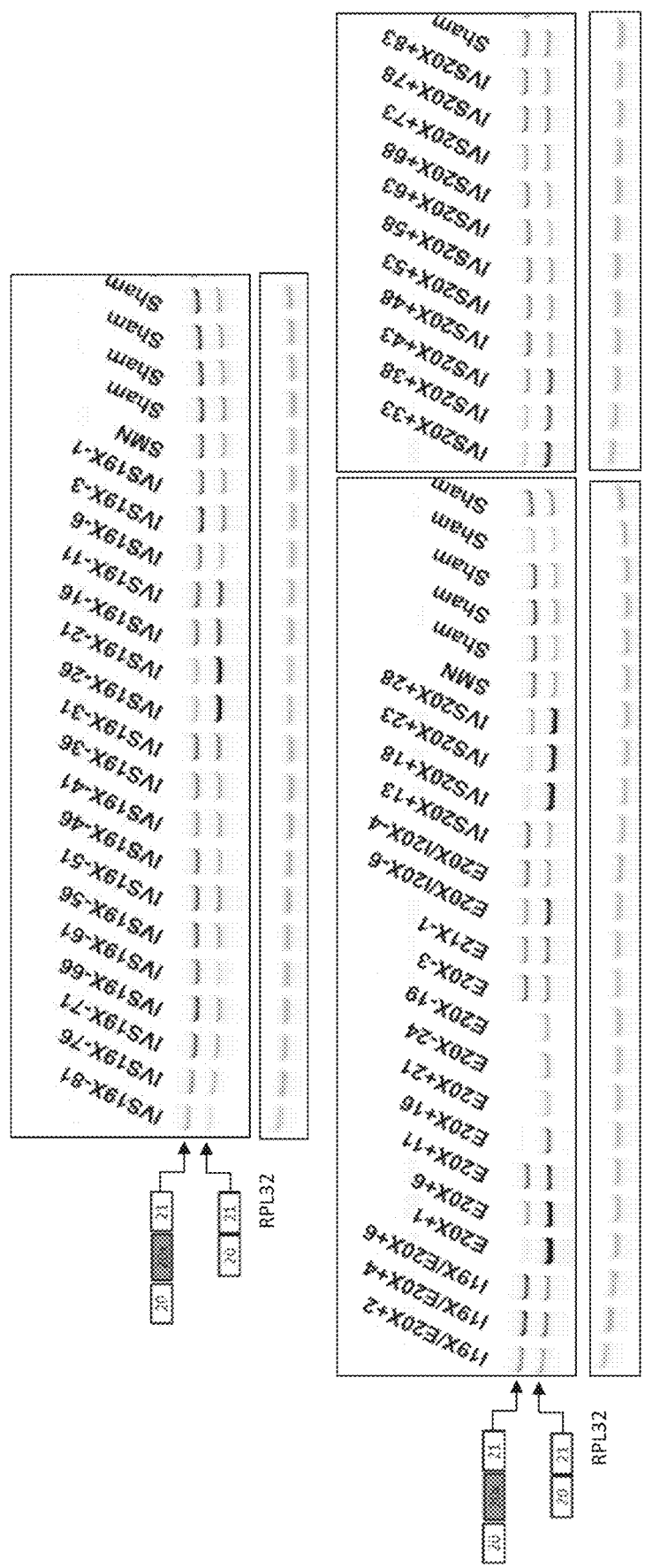
FIG. 5A depicts SCN1A exon 20x region ASO walk evaluated by RT-PCR. A representative PAGE shows SYBR-safe-stained RT-PCR products of SCN1A mock-treated (Sham), SMN-control ASO treated (SMN), or treated with a 2'-MOE ASO targeting the exon 20x region as described herein in the Examples and in the description of FIG. 4, at 20 µM concentration in RenCell VM cells by gymnotic uptake. Two products corresponding to exon 20x inclusion (top band) and full-length (exon 20x exclusion, bottom band) were quantified.
Figure 5B:
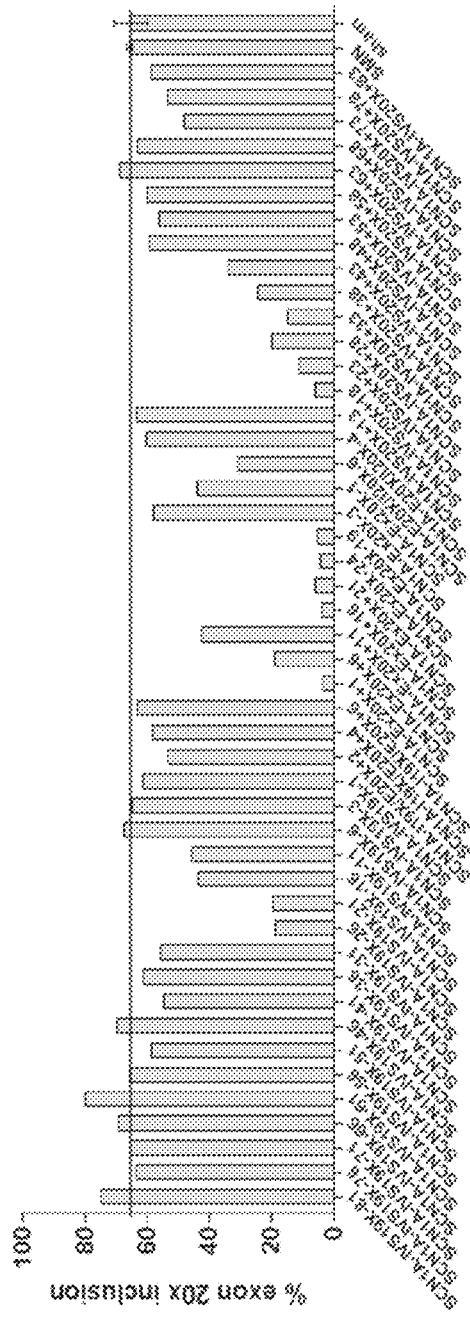
FIG. 5B depicts a graph plotting the percent exon 20x inclusion from the data in FIG. 5A. The black line indicates no change with respect to Sham.
Figure 5C:
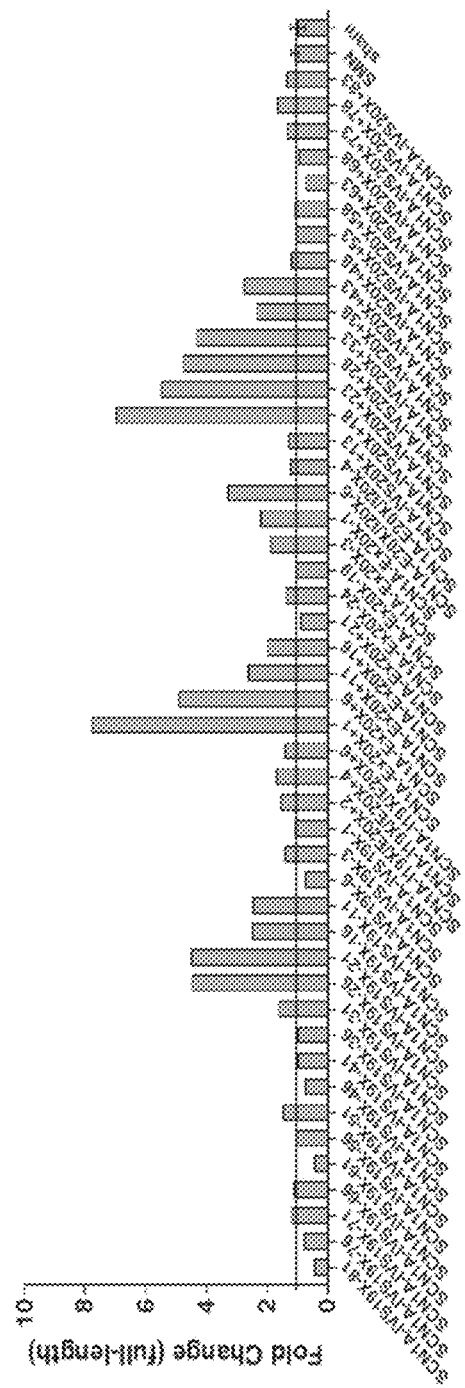
FIG. 5C depicts a graph of the full-length products normalized to RPL32 internal control and the fold-change relative to Sham is plotted. The black line indicates a ratio of 1 and no change with respect to Sham.

ASO walk sequences can be evaluated by for example RT-PCR. In FIG. 5A, a representative PAGE shows SYBR-safe-stained RT-PCR products of SCN1A mock-treated (Sham), SMN-control ASO treated (SMN), or treated with a 2'-MOE ASO targeting the exon 20x region as described herein in the Example 3 and in the description of FIG. 4, at 20 µM concentration in RenCell VM cells by gymnotic uptake. Two products corresponding to exon 20x inclusion (top band) and full-length (exon 20x exclusion, bottom band) were quantified and percent exon 20x inclusion is plotted in the bar graph (FIG. 5B). The black line indicates no change with respect to Sham. The full-length products were also normalized to RPL32 internal control and fold-change relative to Sham is plotted in the bar graph (FIG. 5C). The black line indicates a ratio of 1 and no change with respect to Sham.

Example 5: SCN1A Exon 20x Region ASO Walk Evaluated by RT-qPCR

Figure 6:
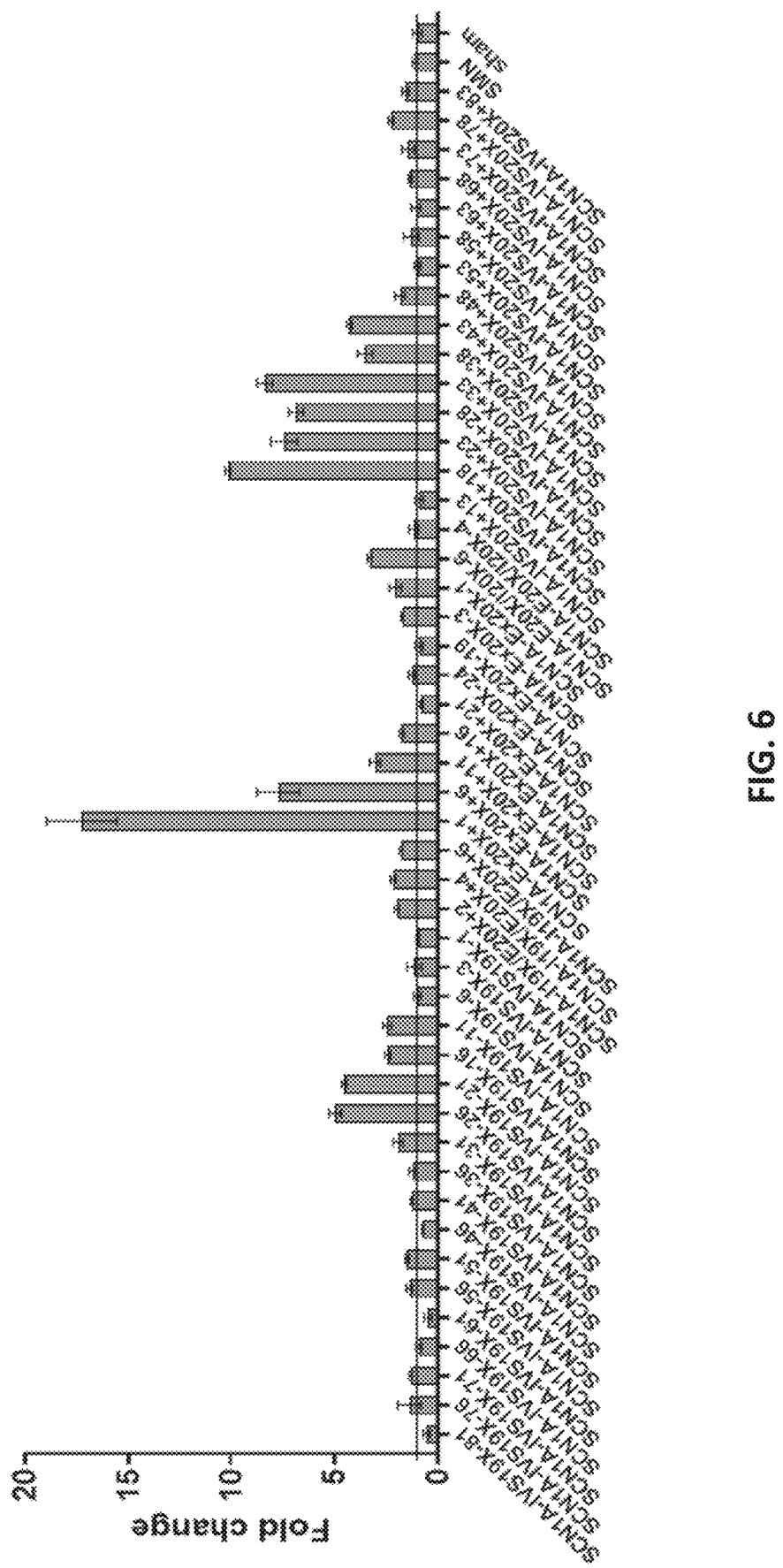
FIG. 6 depicts an exemplary SCN1A exon 20x region ASO walk evaluated by RT-qPCR. SYBR-green RT-qPCR SCN1A amplification results normalized to RPL32, obtained using the same ASO uptake experiment that were evaluated by SYBR-safe RT-PCR as shown in FIG. 5, are plotted as fold change relative to Sham confirming the SYBR-safe RT-PCR results. The black line indicates a ratio of 1 (no change with respect to sham).

SYBR-green RT-qPCR SCN1A amplification results normalized to RPL32, obtained using the same ASO uptake experiment that were evaluated by SYBR-safe RT-PCR as shown in FIG. 6, are plotted as fold change relative to Sham confirming the SYBR-safe RT-PCR results. The black line indicates a ratio of 1 (no change with respect to sham).

Example 6: Dose-Dependent Effect of Selected ASO in CXH-Treated Cells

Figure 8A:
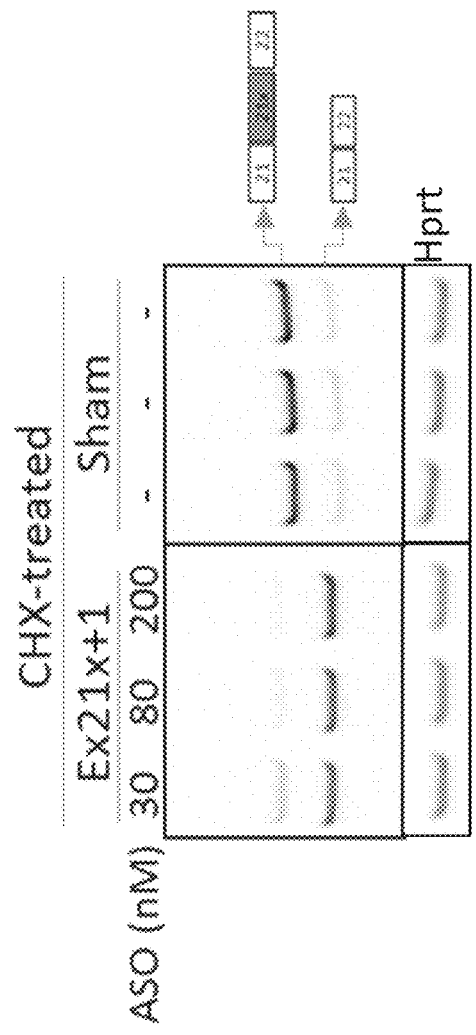
FIG. 8A depicts exemplary dose-dependent effect of selected ASO in CXH-treated cells. A representative PAGE showing SYBR-safe-stained RT-PCR products of mouse Scn1a mock-treated (Sham, RNAiMAX alone), or treated with Ex21x+1 2'-MOE ASO targeting the exon 21x (mouse nomenclature, corresponds to human exon 20x), at 30 nM, 80 nM, and 200 nM concentrations in Neuro 2A (mouse neuroblastoma) cells by RNAiMAX transfection is shown. Ex21x+1 (mouse nomenclature) and Ex20x+1 (human nomenclature) are identical. Two products corresponding to exon 20x inclusion (top band) and full-length (exon 20x exclusion, bottom band) were quantified.
Figure 8C:
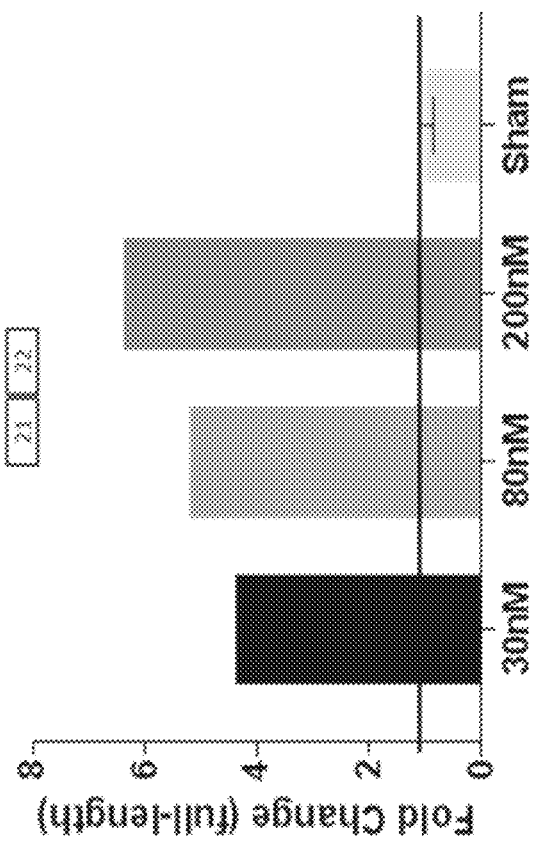
FIG. 8C depicts an exemplary graph of the full-length products normalized to Hprt internal control and fold-change relative to Sham are plotted. The black line indicates a ratio of 1 and no change with respect to Sham.
Figure 8B:
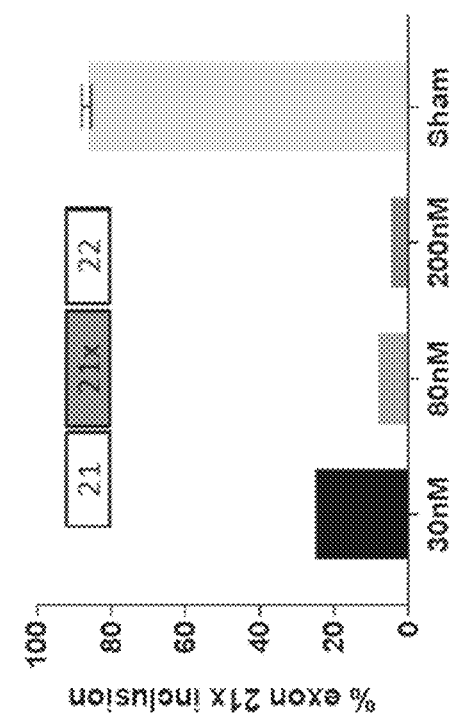
FIG. 8B depicts a graph plotting the percent exon 20x inclusion from the data in FIG. 7A. The black line indicates no change with respect to Sham.

In FIG. 8A, a representative PAGE shows SYBR-safe-stained RT-PCR products of mouse Scn1a mock-treated (Sham, RNAiMAX alone), or treated with Ex21x+1 2'-MOE ASO targeting the exon 21x (mouse nomenclature, corresponds to human exon 20x), at 30 nM, 80 nM, and 200 nM concentrations in Neuro 2A (mouse neuroblastoma) cells by RNAiMAX transfection. Ex21x+1 (mouse nomenclature) and Ex20x+1 (human nomenclature) are identical. Two products corresponding to exon 21x inclusion (top band) and full-length (exon 21x exclusion, bottom band) were quantified and percent exon 21x inclusion is plotted in the bar graph (FIG. 8B). The full-length products were also normalized to HPRT internal control and fold-change relative to Sham is plotted in the bar graph (FIG. 8C). The black line indicates a ratio of 1 and no change with respect to Sham.

Example 7: Intravitreal (IVT) Injection of Selected ASOs

FIG. 9A shows PAGEs of SYBR-safe-stained RT-PCR products of mouse Scn1a from PBS-injected (1 µL) left eye (−) or IVS20x-21, Ex21x+1, IVS21x+18, IVS21x+33 or Cep290 (negative control ASO; Gerard et al, *Mol. Ther. Nuc. Ac.*, 2015) 2'-MOE ASO-injected (1 µL) right eye (+) at 10 mM concentration. Ex21x+1, IVS21x+18, and IVS21x+33 (mouse nomenclature) and Ex20x+1, IVS20x+18, and IVS20x+33 (human nomenclature) are identical. Two products corresponding to exon 21x inclusion (top band) and full-length (exon 21x exclusion, bottom band) were quantified and percent exon 21x inclusion is plotted in FIG. 9B. White bars correspond to ASO-injected eyes and grey bars correspond to PBS-injected eyes, n=5 in each group. The full-length products were normalized to GAPDH internal control and fold-change of ASO-injected eye relative to PBS-injected eye is plotted in FIG. 9C. The black line indicates a ratio of 1 and no change with respect to PBS, n=5 in each group.

Example 8: Intracerebroventricular (ICV) Injection of Selected ASOs

FIG. 10A shows PAGEs of SYBR-safe-stained RT-PCR products of mouse Scn1a from uninjected (-, no ASO control), or 300 µg of Cep290 (negative control ASO; Gerard et al, *Mol. Ther. Nuc. Ac.*, 2015), Ex21x+1, IVS21x+18, IVS21x+33 2'-MOE ASO-injected brains. Ex21x+1, IVS21x+18, and IVS21x+33 (mouse nomenclature) and Ex20x+1, IVS20x+18, and IVS20x+33 (human nomenclature) are identical. Two products corresponding to exon 21x inclusion (top band) and full-length (exon 21x exclusion, bottom band) were quantified and percent exon 21x inclusion was plotted in the bar graph in FIG. 10B, n=6 (each targeting ASO), n=5 (Cep290 ASO), n=1 (uninjected, no ASO control). Taqman PCR was performed using two different probes spanning exons 21 and 22 junction and the products were normalized to GAPDH internal control and fold-change of ASO-injected relative to Cep290-injected brains was plotted in the bar graph in FIG. 10C. The black line indicates a ratio of 1 and no change with respect to Cep290, n=6 (each targeting ASO), n=5 (Cep290 ASO), n=1 (uninjected, no ASO control).

FIGS. 11A-C depict exemplary dose-dependent response from ICV injection of selected ASOs in C57BL6J mice (male, 3 months old). FIG. 11A shows PAGE gels of SYBR-safe-stained RT-PCR products of mouse Scn1a from 300 ug of Cep290 (negative control ASO; Gerard et al, *Mol. Ther. Nuc. Ac.*, 2015), or 33 ug, 100 ug, and 300 ug of Ex21x+1 2'-MOE ASO-injected brains. Ex21x+1 (mouse nomenclature) and Ex20x+1, (human nomenclature) are identical. Two products corresponding to exon 21x inclusion (top band) and full-length (exon 21x exclusion, bottom band) were quantified. FIG. 11B depicts a graph plotting the percent exon 21x inclusion from the data in FIG. 11A, n=5 (each group). FIG. 11C depicts a graph from results of a Taqman qPCR assay performed using two different probes spanning exons 21 and 22 junction. The products were normalized to Gapdh internal control and fold-change of ASO-injected relative to Cep290-injected brains is plotted. The black line indicates a ratio of 1 and no change with respect to Cep290, n=5 (each group).

FIGS. 12A-C depict exemplary results from ICV injection of a selected ASO in C57BL6J mice (postnatal day 2). FIG. 12A shows PAGE gels of SYBR-safe-stained RT-PCR products of mouse Scn1a from uninjected (-, no ASO control), or 20 µg Ex21x+1 2'-MOE ASO-injected brains are shown. Two products corresponding to exon 21x inclusion (top band) and full-length (exon 21x exclusion, bottom band) were quantified. Ex21x+1 (mouse nomenclature) and Ex20x+1 (human nomenclature) are identical. FIG. 12B depicts a graph plotting the percent exon 21x inclusion from the data in FIG. 12A, n=4 (each group). FIG. 12C depicts a graph from results of a Taqman qPCR assay performed using two different probes spanning exons 21 and 22 junction. The products were normalized to Gapdh internal control and fold-change of ASO-injected relative to no-ASO-control brains is plotted. The black line indicates a ratio of 1 and no change with respect to no-ASO control, n=4 (each group).

Figure 13B:
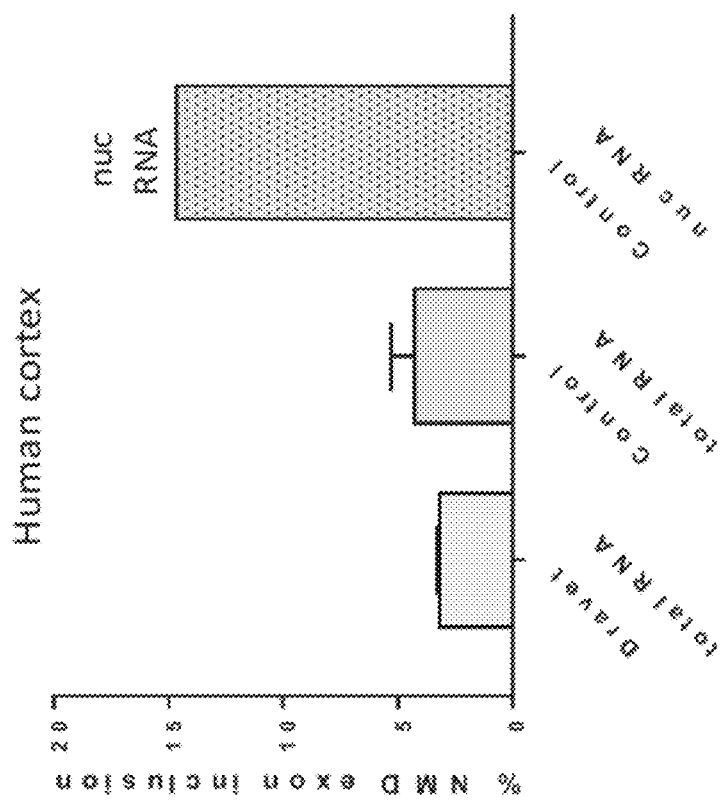
FIG. 13B depicts a graph plotting the percent exon 20x inclusion in the indicated human CNS samples.
Figure 13A:
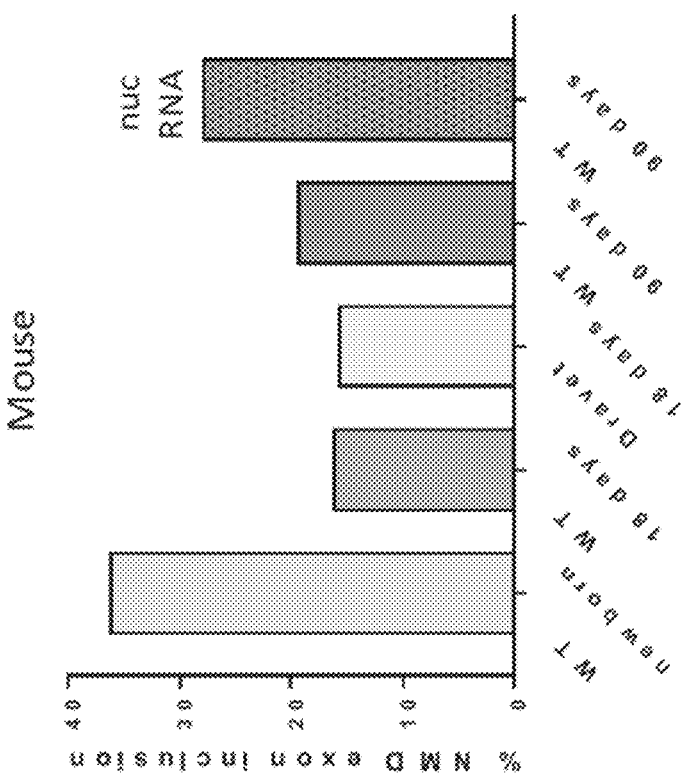
FIG. 13A depicts a graph plotting the percent exon 21x inclusion in the indicated mouse CNS samples.

Example 9: Targeted Augmentation of Nuclear Gene Output for the Treatment of Dravet Syndrome Dravet syndrome (DS) is a devastating childhood genetic disease characterized by severe seizures, cognitive & motor impairments and death. The primary cause of DS is decreased expression of the sodium voltage-gated channel type 1 alpha subunit (Nav1.1). SCN1A non-productive splicing event is conserved between human and mouse. FIG. 13A depicts a graph plotting the percent exon 21x inclusion in the indicated mouse CNS samples. FIG. 13B depicts a graph plotting the percent exon 20x inclusion in the indicated human CNS samples. In this study, an antisense oligonucleotides (ASO) therapy was utilized to increase productive Scn1a mRNA and consequently restore levels of Na$_v$1.1 protein.

FIG. 14A depicts a graph plotting the percent decrease in exon 21x inclusion at the indicated doses (n=3-6 per group). FIG. 14B depicts a graph plotting the percent increase in Scn1a mRNA at the indicated doses (n=3-6 per group). FIG. 14C depicts a graph plotting the percent increase in Nav 1.1 protein levels at the indicated doses (n=2 per group).

Figure 15B:
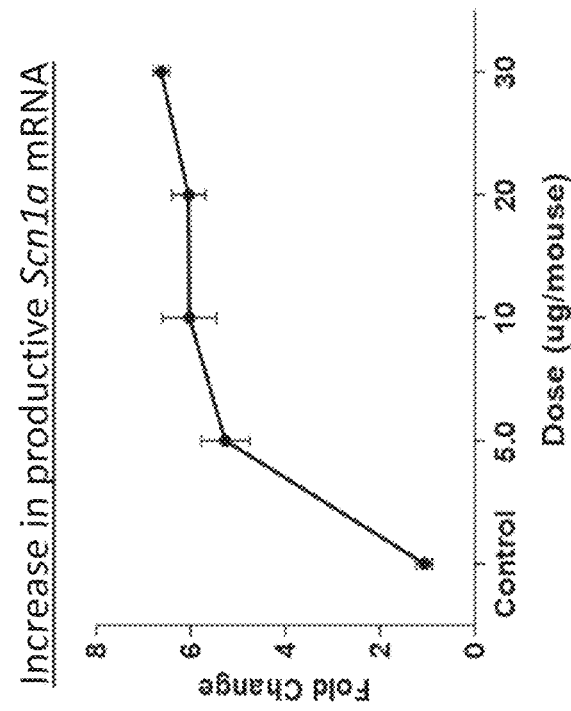
FIG. 15B depicts a graph plotting the percent increase in Scn1a mRNA at the indicated doses.
Figure 15A:
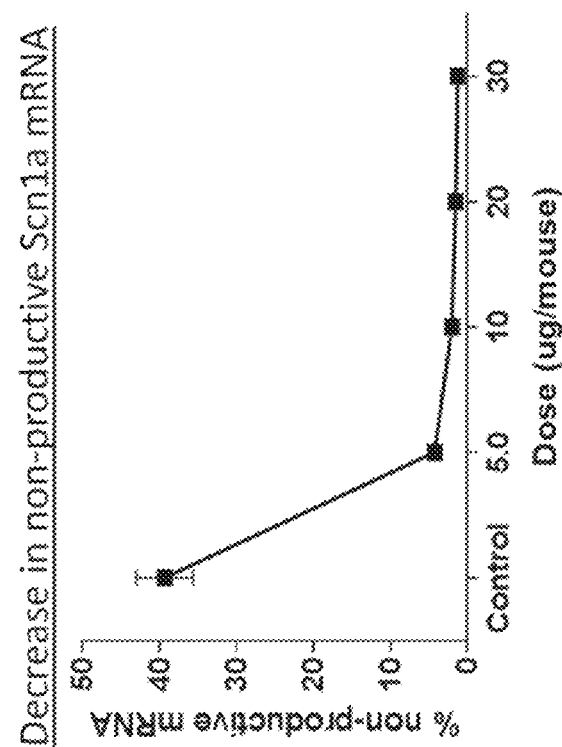
FIG. 15A depicts a graph plotting the percent decrease in exon 21x inclusion at the indicated doses.

FIG. 15A depicts a graph plotting the percent decrease in exon 21x inclusion at the indicated doses (n=4 per group). FIG. 15B depicts a graph plotting the percent increase in Scn1a mRNA at the indicated doses (n=4 per group).

Figure 16:
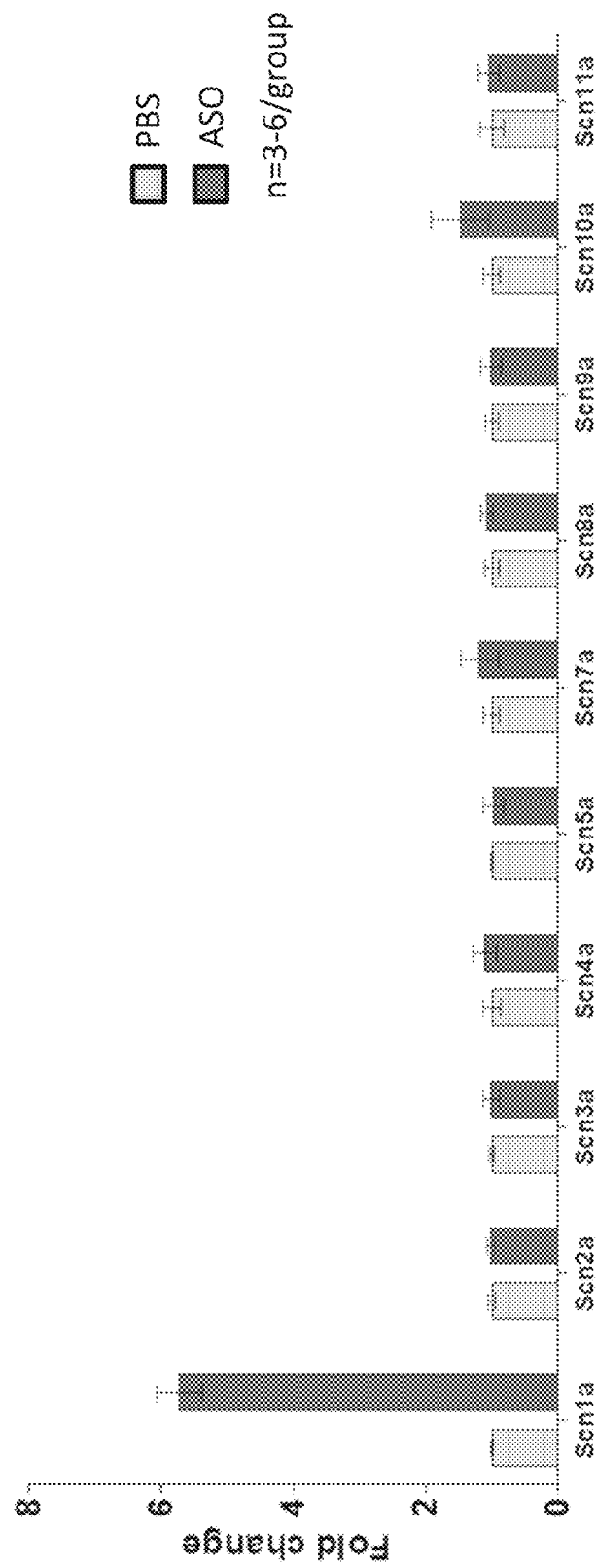
FIG. 16 depicts a selected Scn1a targeting ASO administered at a bug dose via ICV injection in postnatal day 2 mice evaluated at day 5 post-injection by Taqman qPCR of SCN1A, SCN2A, SCN3A, SCN4A, SCN5A, SCN7A, SCN8A, SCN9A, SCN10A, and SCN11A to assess target selectivity. Taqman-qPCR amplification results normalized to Gapdh, obtained using Ex20x+1 ASO, are plotted as fold change relative to PBS injected mice.

FIG. 16 depicts a selected Scn1a targeting ASO administered at a bug dose via ICV injection in postnatal day 2 mice evaluated at day 5 post-injection by Taqman qPCR of SCN1A, SCN2A, SCN3A, SCN4A, SCN5A, SCN7A, SCN8A, SCN9A, SCN10A, and SCN11A to assess target selectivity. Taqman-qPCR amplification results normalized to Gapdh, obtained using Ex20x+1 ASO, are plotted as fold change relative to PBS injected mice (n=3-6 per group).

Figure 17B:
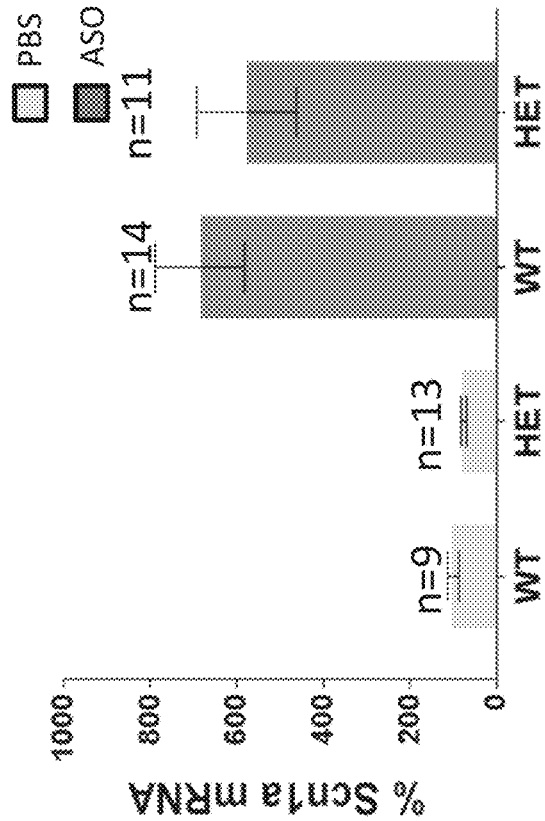
FIGS. 17A and 17B depict exemplary results from intracerebroventricular (ICV) injection at postnatal day 2 of a selected ASO at the indicated dose in wild type (WT) or heterozygous Dravet mice (HET) F1 mice from 129S-Scn1a$^{tm1Kea}$×C57BL/6J crosses at 3 days post-injection.
Figure 17A:
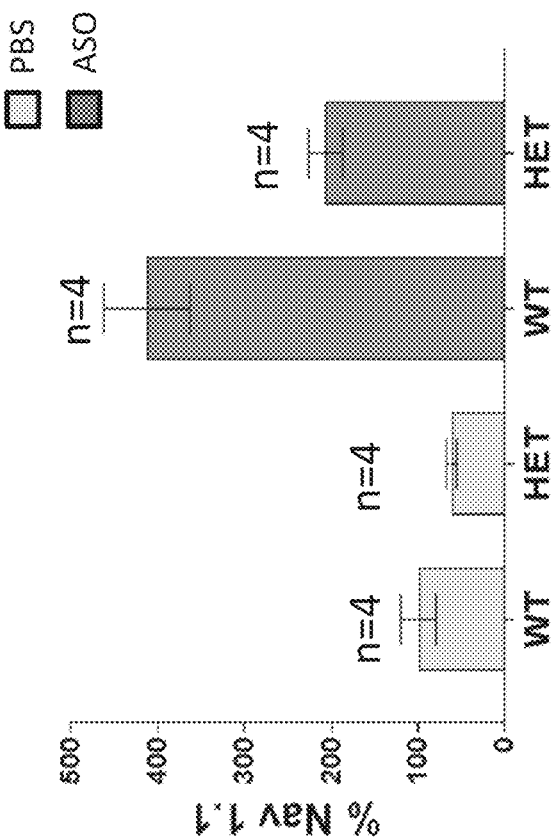

FIGS. 17A-B depict exemplary results from intracerebroventricular (ICV) injection at postnatal day 2 of a selected ASO at the indicated dose in wild type (WT) or heterozygous Dravet mice (HET) F1 mice from 129S-Scn1a$^{tm1Kea}$×C57BL/6J crosses at 3 days post-injection (n=9-14 per group). FIG. 17A depicts a graph from results of a Taqman qPCR assay performed using a probe spanning exons 21 and 22. The products were normalized to Gapdh internal control and fold-change of ASO-injected relative to PBS-injected brains is plotted. FIG. 17B depicts a graph from results of a western blot performed using an anti-Nav1.1 antibody. The products were normalized to Ponceau-stained bands and fold-change of ASO-injected relative to PBS-injected brains is plotted.

Figure 19:
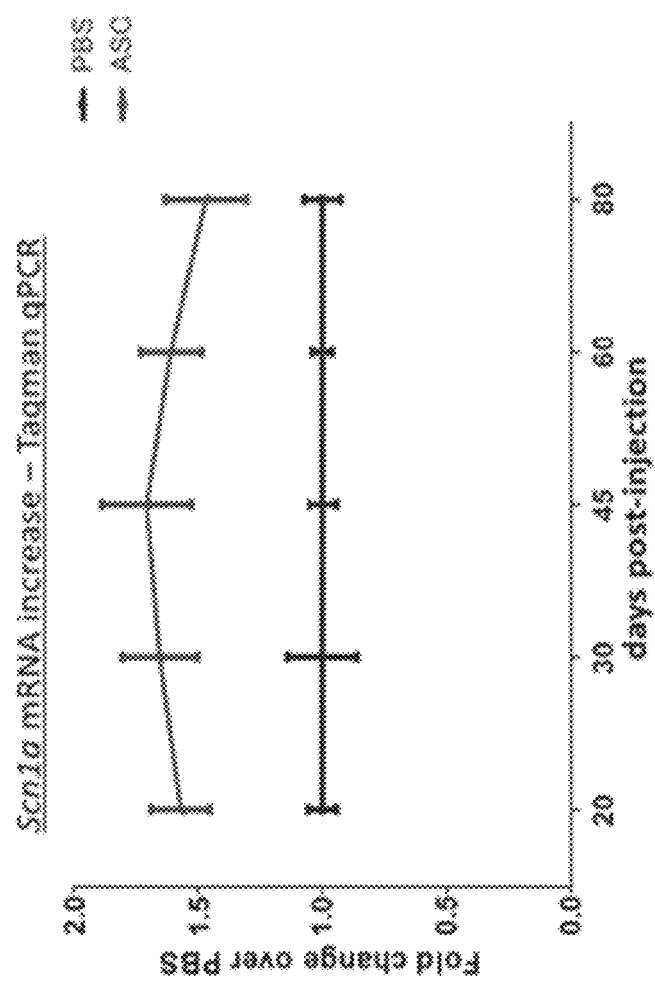
FIG. 19 is a graph plotting increase in Scn1a mRNA level in coronal brain slices of mice over the time post injection of a SCN1A targeting ASO. As depicted, increase in Scn1a mRNA level was maintained for at least 80 days post-injection.

FIG. 19 is a graph plotting increase in Scn1a mRNA level in coronal brain slices of mice over the time post ICV injection of a SCN1A targeting ASO. As depicted, increase in Scn1a mRNA level, as quantified by Taqman qPCR, was maintained for at least 80 days post-injection (n=3-9 per group).

Figure 20:
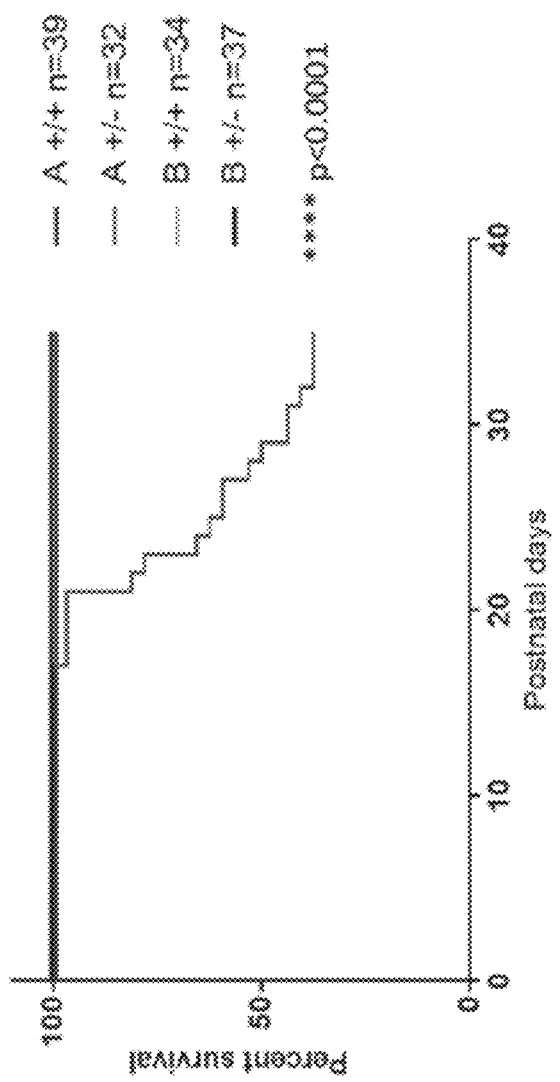
FIG. 20 is an exemplary survival curve demonstrating 100% survival benefit provided by a SCN1A targeting ASO in Dravet mouse model. +/+ stands for WT genotype, and +/− stands for 129S-scn1a$^{tm1Kea}$ heterozygous genotype (Dravet mouse model); A stands for PBS treatment, and B stands for ASO treatment. As depicted, mice in A +/− group (Dravet mice receiving PBS treatment) started to die from about postnatal day 16, whereas all mice of other three groups, including B+/−(Drave mice receiving ASO treatment) group, survived through at least postnatal day 35.

FIG. 20 is an exemplary survival curve demonstrating 100% survival benefit provided by a SCN1A targeting ASO in Dravet mouse model. WT and heterozygous Dravet mice (+/−), F1 offspring from 129S-scn1a$^{tm1Kea}$×C57BL/6J crosses, received a single dose ICV injection of 20 µg PBS or ASO blindly (treatment marked as A or B) on postnatal day 2, and their survival was monitored. As depicted, mice in A +/− group (Dravet mice receiving PBS treatment) started to die from about postnatal day 16, whereas all mice of other three groups, including B+/−(Drave mice receiving ASO treatment) group, survived at least 35 days postnatal (n=32-39 per group).

Figure 18:
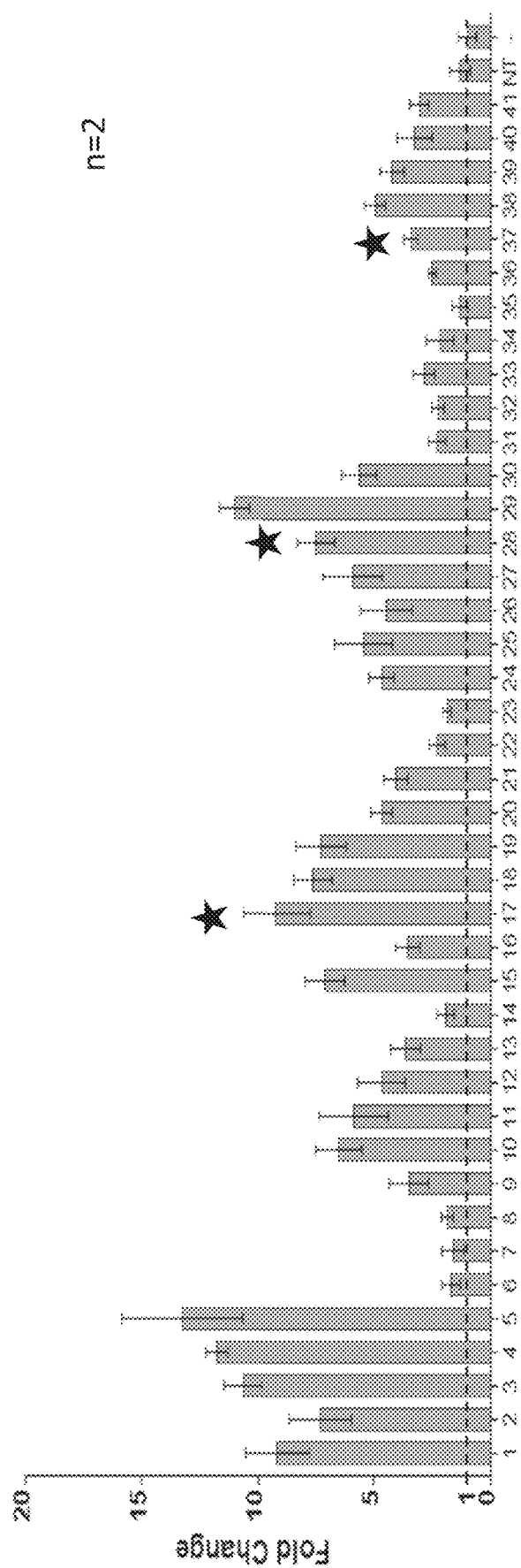
FIG. 18 depicts exemplary results of a SCN1A exon 20x region ASO microwalk in RenCells via free uptake. ASOs were designed to cover regions around three previously identified targeting ASOs in FIG. 6 (marked by stars) by shifting 1 nucleotides at a time (6-41) or by decreasing the length of ASO 17 (1-5). The graph depicts the percent exon 20x inclusion as measured by SYBR-green qPCR. The black line indicates no change with respect to no ASO (−).

FIG. 18 depicts exemplary results of a SCN1A exon 20x region ASO microwalk in RenCells via free uptake. ASOs were designed to cover regions around three previously identified targeting ASOs in FIG. 6 (marked by stars) by shifting 1 nucleotides at a time (6-41) or by decreasing the length of ASO 17 (1-5). The graph depicts the percent exon 20x inclusion as measured by SYBR-green qPCR. The black line indicates no change with respect to no ASO (−).

Sequences of ASOs are summarized in Table 7a and Table 7b.

TABLE 7a

Sequences of ASOs targeting human SCN1A

| ASO ID | Sequence 5'-3' | SEQ ID NO: |
|---|---|---|
| 1 | TTGGAGCAAGATTATC | 304 |
| 2 | GTTGGAGCAAGATTATC | 305 |
| 3 | GTTGGAGCAAGATTAT | 306 |
| 4 | AGTTGGAGCAAGATTAT | 307 |
| 5 | AGTTGGAGCAAGATTA | 308 |
| 6 | GATTATCCTATACAAAAT | 309 |
| 7 | AGATTATCCTATACAAAA | 310 |
| 8 | AAGATTATCCTATACAAA | 311 |
| 9 | CAAGATTATCCTATACAA | 312 |
| 10 | GCAAGATTATCCTATACA | 313 |
| 11 | AGCAAGATTATCCTATAC | 314 |
| 12 | GAGCAAGATTATCCTATA | 315 |
| 13 | GGAGCAAGATTATCCTAT | 316 |
| 14 | TGGAGCAAGATTATCCTA | 317 |
| 15 | GTTGGAGCAAGATTATCC | 318 |
| 16 | TTGGAGCAAGATTATCCT | 319 |
| 18 | AAGTTGGAGCAAGATTAT | 320 |
| 19 | CAAGTTGGAGCAAGATTA | 321 |
| 20 | CCAAGTTGGAGCAAGATT | 322 |
| 21 | TCCAAGTTGGAGCAAGAT | 323 |
| 22 | AGTACCCATAATAAAGGG | 324 |
| 23 | AATACAGTACCCATAATA | 325 |
| 24 | ATTAAAGGTAGCAAAAGG | 326 |
| 25 | GATTAAAGGTAGCAAAAG | 327 |
| 26 | GGATTAAAGGTAGCAAAA | 328 |
| 27 | AGGATTAAAGGTAGCAAA | 329 |
| 29 | CAAGGATTAAAGGTAGCA | 330 |
| 30 | GCAAGGATTAAAGGTAGC | 331 |
| 31 | TGCAAGGATTAAAGGTAG | 332 |
| 32 | GTGCAAGGATTAAAGGTA | 333 |
| 33 | AGTCACAGTGCAAGGATT | 334 |
| 34 | AAGTCACAGTGCAAGGAT | 335 |
| 35 | TAAGTCACAGTGCAAGGA | 336 |
| 36 | ATAAGTCACAGTGCAAGG | 337 |
| 38 | ACATAAGTCACAGTGCAA | 338 |
| 39 | CACATAAGTCACAGTGCA | 339 |
| 40 | ACACATAAGTCACAGTGC | 340 |
| 41 | TACACATAAGTCACAGTG | 341 |

TABLE 7b

Sequences of ASOs targeting human SCN1A

| ASO ID | Sequence 5'-3' | SEQ ID NO: |
|---|---|---|
| 1_U | UUGGAGCAAGAUUAUC | 342 |
| 2_U | GUUGGAGCAAGAUUAUC | 343 |
| 3_U | GUUGGAGCAAGAUUAU | 344 |
| 4_U | AGUUGGAGCAAGAUUAU | 345 |
| 5_U | AGUUGGAGCAAGAUUA | 346 |
| 6_U | GAUUAUCCUAUACAAAAU | 347 |
| 7_U | AGAUUAUCCUAUACAAAA | 348 |
| 8_U | AAGAUUAUCCUAUACAAA | 349 |
| 9_U | CAAGAUUAUCCUAUACAA | 350 |
| 10_U | GCAAGAUUAUCCUAUACA | 351 |
| 11_U | AGCAAGAUUAUCCUAUAC | 352 |
| 12_U | GAGCAAGAUUAUCCUAUA | 353 |
| 13_U | GGAGCAAGAUUAUCCUAU | 354 |
| 14_U | UGGAGCAAGAUUAUCCUA | 355 |
| 15_U | GUUGGAGCAAGAUUAUCC | 356 |
| 16_U | UUGGAGCAAGAUUAUCCU | 357 |
| 18_U | AAGUUGGAGCAAGAUUAU | 358 |
| 19_U | CAAGUUGGAGCAAGAUUA | 359 |
| 20_U | CCAAGUUGGAGCAAGAUU | 360 |
| 21_U | UCCAAGUUGGAGCAAGAU | 361 |
| 22_U | AGUACCCAUAAUAAAGGG | 362 |
| 23_U | AAUACAGUACCCAUAAUA | 363 |
| 24_U | AUUAAAGGUAGCAAAAGG | 364 |
| 25_U | GAUUAAAGGUAGCAAAAG | 365 |
| 26_U | GGAUUAAAGGUAGCAAAA | 366 |
| 27_U | AGGAUUAAAGGUAGCAAA | 367 |
| 29_U | CAAGGAUUAAAGGUAGCA | 368 |
| 30_U | GCAAGGAUUAAAGGUAGC | 369 |
| 31_U | UGCAAGGAUUAAAGGUAG | 370 |
| 32_U | GUGCAAGGAUUAAAGGUA | 371 |
| 33_U | AGUCACAGUGCAAGGAUU | 372 |
| 34_U | AAGUCACAGUGCAAGGAU | 373 |
| 35_U | UAAGUCACAGUGCAAGGA | 374 |
| 36_U | AUAAGUCACAGUGCAAGG | 375 |
| 38_U | ACAUAAGUCACAGUGCAA | 376 |
| 39_U | CACAUAAGUCACAGUGCA | 377 |
| 40_U | ACACAUAAGUCACAGUGC | 378 |
| 41_U | UACACAUAAGUCACAGUG | 379 |

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

SEQUENCE LISTING (383 sequences)

SEQ ID NO: 1 - DNA, 164521 bp, Homo sapiens
ataaataaaagttgcattccatgaggagaaaacaaaaaaacccatcacagtgaacaattgaattgctccgtggacatcatgcctttctaagcaagcattgaatataggagatgtatttatgataaccagagacagagtatgtatagcttggctccataggggtggtgttctcggttcctatgtctaccttttgtattttccagcccttccctcataatgttactgggaaagttaacagctagcataacattttgaaaacccaaagtgtttatatcaacaagattattcacagtcaaattttcccataaatatcactgggacctatatttcttttaattttaaccaagagtgaaggtagtgagtatagagccctggctttagaaactaacctttaaaaataatgagataatgacacagtgaataaagatgcatcagggttgagcaaagttattttttaagattagaaaaactgattttgaaaatgcaaaggcagacaaaaaggatcagtcaagagggaaagaataaagatagaagagaagtagaacaagtcatggagcaaggtatctgagaatgtagaaatgaatgggaaaaattgatctctgaaaagatataaaagtatggattgaaggaaggaaggaaggagagggagagaggaaggaagggagagagggaggaagggagaaagggaaaggtaggagggggaggtaaagtaagaaaaaggaaggaaaaaggaagagaatggaaggaaagaaaaaggaaggaaaaaggaagagaatggaaggaaagaaaaaggaagggaagggaaggaaaagggaagggaaaagggacttagatatttttcactggataggaaagaaattgaggaagtttataatgatgtcctcttgcttgttgctgaggtgaggggctgagttatctgcaaatatgaggagtgttctaacggaatgataaaggactcaagcagttgagtaaaatcaattgatattgcaaattatccacttgtgattttaagaatttcttggtgatgcaattttcccatctatacttgattgtctagagtattttcctcctctagtgcctttgctgccacactgattaaatcaatattgattgacaacctcagtgggatatttccatgtgccaggaagaatagtactatcagcagtacccaattcatggtggtttagaaacacatttattttcttatataataagaaattccagtgcacacatgaagaatatgcaattaccagacatatttgctgtctttagtgcgacaagtttatatagttcgagtgtctgggctttgtgatacagatatacaaacatacaaacttatgcagtagagttgtctgtcccaatggttactagacttttggatttcatgcaccagtaaaatacaaatgggaggaccgacaccaggttgccaattttccacttggctaaataaaatattaaaaccaatgacccattatcacgtattctcaccatcatttccaaagaacatttaaacattaaatggtattagtctttagaaaataatctaaaagatacaatttcaggataaaggtctttaacttggatatgttcagctttataaatatttatggcattattcttaattttctggcttaactatagacatatgaaaaccttgtcataagggtgctgctctgtggagctgtgtttggaattactatttatacccacagtgtctggtccccagcttaaacagcaaagtgccaccttctgttatccaaatcagatctgtttagcatcaaatactggggtcttaaccactatgccgcagatcttttctaaaatattcttattttaattaaacagtgattattatgaagaacaaggaatgtaatcatttctgtgacttttcaggaagattactgctaggaaatgagaatagtagttaaaaaaccagtatatattgaattaattaccaacagtagatctaattttgaaggtagaaattataaagtccagggcatacaaaatatgatagtgtgaacacgcagacataggcacttcagtaacacacagcaaaaaaaaaaaaaaaatcctcccctttctaaagacacacacacatctatacttttatctatgtctgtttacatacatacatatatatataaatgtaactcatttttctttgaactgattcaagaatgagctgcagacattgttgcattcacccctaaatactttagcatgcattttcagagaataagaacattttctattttcatggaacaggcacactagtcttaacaaaattaggaaaattaacactattataatactaataactaataaacagtccatattcaaatttattcaactttcccaataatattatttatctgttattttttaatttgatattccatccagaattgtgtttagttgtcatagttctttgacctcatggaattctttagcctttctttgtctttcatgacattgacatttttaaggagttcagtccacttattttatagagtgtcctcaatttgattttccttgtagttagattctggttttaaaattttgactgtgtaccaagaagtaatgtggccctttcagtatatcttatcaggaggcacatagtatcagttggtctcataattgatgatatctttgaaggtattgtctgctgtatttctccaaagtatactttcttctgtttaaattttctacttaatagagaagagatactttaagatgctataaataccctattcctcatcaaactttcacccatgagttttaatactcattgatgattcttgtatgaatcaattgtcattagggtgattgccaaatagtgatttttctaactccgttatttcttctacaattgttaattaacattcaactgcaagaaacagatttgtacttttccttatttacttacatcagtatgtatttgctgattcttattcaatgaattataatcttttactatcatttattttgatgctcaacttgccccagatttggccagtgggaagccccttctagttggttcctgtgtcttactgacatgacctcatcattctttgaagaataattactttttagcacagaaaatatcatgccaaatatttcaaaatgaatatggagatttatatgattatgttttaccagttcttctctttgtatttggaaaggtaacagtgagtaatggcgtggatgggtagtataaaaagtctgcagggtttatcctataattctgacctaccttagttggaaatgggaatttttttcagctactaatatatcagaattaattgttgtgttgctttaggattgtgatgttatgaagaggcaaagtcagtccattgtacaaggatgggaaaagccttttaattactgtcccttttctggttgaggctatattccctcttctggcttcacctgatgacaagggaaggcttctcgttcctcagaaatttagatagattaatttagactgttaattttactatctggaccacccgagtaacctttccatgatatctgtgaattctgcactggacttcactgtggttcccccagttactgtttttctttatctgcaaaagttagcaagattaagaccccaagctgaagcaaggcacatctttgcttcctgctgactttcatgagctgttgaatcaccttgtgtcagccaggcaggagacagatggcatgctgaaatgaggcatatagaagaatttcatgaaggggacatttacaaaagtgtcagcaatgttaggagaaagctacaaggaatacaaaagcactctcaatgcagcagcagacctgaaggagcaaggggaggagtgattacctgaccccagagaaagtagcttcagttgtatgaggggcagtctgattggagtatgacttttcggggaggaatgagtccagtgccaacccagcaaagaaggaattggagaagaaatattcctatgtcaatcttctctctctggtgctttcccactggtgcttctcattggccaaaccaattgggagctcaaaggtaggagagcccatttttgcaatgtgtagaagtcacccttctgggacacacagaatgatgcagaagcagagagagtggctctggaggagcaaacacagtatcctacacacatggcaattctaaatttttaaatgatgatttaagggtttcttttcatagctcaaggggtcatccaccatcactctggcttccatacttctcttcctcctagaatcactagctatcctctgacaccagttcttcctcctaacagagaacacacctgctgcttgtaattctgggaggtcattaccccctacctccagtgacatatctaccctaggttttgttgtcaacgtgggtatgcctctgtgtgtgtgtgtgtgtgtgtgtgtgtgtgtgtgtgtgtgcgcgcgcgctccccttctcccccaatttgtaatgtaaaaaatctccatatcattagaatattctgttaacaaaaagtgactgggcaaacaataaaataaaaaatgtaatctttattagttttgcacattttaaatgttggttagcattatttagcataatagtagcattttccagcatgcagttcacgaatacagtttatctaagtagttttaaggaaaagaggagcctatggtttgcttctgtaagaaacacaaaatgtcctgatgtaattgactatataagttgactactctgtttttgtggaaaaaaaaattatgaagcccacattctatttagaacaatctagagcagcattactccaaagaaatgaaaacataaaccgaagtcagaaaaaaagaacaaaaataacataagcactaccttcaattcagttagtgcaggtactaccagaaatataaataaaattttaaacccttttccaattgcaaagcataatttggatatgaatcgtgaacctattttgctccttaaaattgtgaaataatctaaaattagcaaatgtaatttaaaaagcagaaatctacaactacccagtcttgttttcatgtcttatttagcaaatttctttcatgaaaaagtactatggacagaaagtaagaaaagtgattgtgatatcaacctgaagataatttcctcttcatatttatgtacataatgctgaaaaataaaataaagtgactttttacagtatttatatttgcttataaaattctaaacacatatttaataggttaagcagtgtgtttttttaaacatgtctgtacagtctggctatataccatatgttatccacttaaaatgtaaaaataaccaaaaagctgttaaagtgctgcaaactattgcttaatgacttaaataaatgagatctgttgaacaatttccttgactttaccactgacatatggtttctcataaatgagattctgagcagtgagagaaaccagatacagcagcatggtaatataaacatgcattgatagcatccaaactatctataaatggtacagaatacattttattacctgtgtaaagcttgcactctacatttcttgtggtacatatttgatgcaataaatactgtgcttaggtcattatttgtttgctcaaacgtgcaccacagggtaaaatgactatttacataataaatagcatttcattaacatatacagtgtcaaccttgctgagagccgaagatggctaaacaaagtgcaggaaaaagcagaaatttataaagagtaattttggtcaattcagtcttctggcggtggagggtgaggggcaatattcactattcaggttttttttttaatacaacaaaaagaaacataacatttatgactccaaacatttgaatgaagtttgcacctgctaagatttactggcctacccacaaataatctacttggtctaggggctggatttcgcaaaacaagatcaacaaagcacctccacttatcacccaattacccctcccagaaatatggtgaaatttaagaatttgtttttcttgtgactttttctcatgcatgatctctaagtgcagcatgccctcatgcaaaccacgactttgtgtagctgggagggccatgtggttgccataccccccaggtggcatacctgttatagaggtccttagcctatttctcaacagaaacttcgtttacaaaaatagtcacatataataaacacatggattaacaaaaagatgaatccactaacagattccataaaaatgtgacaaatgtggcagttgaaatgcaaacagtggatacaattactacactaaagtgtttcatgttaaacaaccccaaaatcacaggtttgcaccccttgaaactggtccctacagtctgactagccattgtgcatcttatcttcagcagtgtcagctggtagtgagaacagtaacctcctgtcaaggtcatctcccctttacacagagtcacagtttgctgacaaggggtcactgtcttattgtaggcactgaccttaaggagatttgtgtaaaaacagtcagtttggcattgacctcctaaaggagtcctgttgataaaaatacatcaccttcacaggctgtaaacaatttgtcacccaattatttttatttattttcatttatttccctttggctttttcatctttgccttcttgctcatgtttttccacaattggctttgtcacccggtcataggaaggtggacaagctgcagtggacatggtcagatcagttttttctgtaatagagttttcatttattctgtcaattatcatgtcttcttttataagaagattagccccacctttgattttgtttttattgtacgtaaaggaagcttgttttacagttcgctttaaaaggtggcgtctgtaagcacgctgaataatgacagcagatacttcctcttgttttcgttttaaagtagtagtgattggctgataggagaccttggaaggattggaagccatgaatcgctcttccatctgtattcgtagagcatccatctctccactctctcctagaacccgctttgtaaaagcaaataagatatcaagacagtggatccggtcaccactcaccatgggcaaatccatggcaatgagctggagtttgtttggttgtggcagattgagaggcggttcaagcgcagctgcaaactgagataatttttcaaattccatgaactgagttgcatcgggatcaaacttctcccaaacctcatagaacatctcaaagtcatcctcactcagaggctctgcactttcttcagtagcaacactgaagttctccaggatgaccgcgatgtacatgttcaccacaaccaggaaggatatgatgatgtaactgacaaaaaagaaaattccaacagatgggttcccacagtctcccttaactgagcttccagggttaactttattagggtcacagtcgggtggcttactgttgagaatgggtgctagcaatccatcccagccagcagaggttgtaatttggaataggcagatcatgctgttgccaaaggtctcaaagttgaacatgtcatcgatcccaacttccctcttaacataggcaaagttggacatcccaaagatggcgtagatgaacatgactaggaagagtaggaggccgatgttaaacaacgcaggaagggacatcatcaaagcaaagagcagcgtgcggatcccctttgctcctttgatcagacgtaggattcggccaatcctagcaagacggatcactcggaacagggtaggggacacgaaatacttttctatcagctcggcaagaaacatacctatgaataaacaatgagaataccaaccagtgaagaaatcatgcgttaaaataaacatatgtttcttctaaagctccaaggtaaggttcagagtcctgaacccagttatattaaatatgacaactatatataatatatatataattgtacataatatattataaatcttaattttgaaattcagcaataatttcaattataaggattatagtacttttttttatctttaagagatgtttataaactacttttagtttatgtaaagtcccaagtcagaatttaaaaagaaaataagttaaaaatgcacatttggccgaacagtagcagcccaacagtataggtacaagtttatatgtatacagtgactttttctgaaattgccatattctaaattctctatttactccttttccatctgaaagtattggtagcttttgatgctactttcatctccccatgatcttggtacttacttaaattccactctaatatttttatatactcatttatgtatgttctggtgcatttctgaaaggatcccaggttgatgctctttttagtatcctgtacttaatgttgtatttcaattctttttggtctcctgtacctaacactgtaatctcagtcttcttattttcagcttctctctccatttgctttttagataaaaacaatacttgtaaagttaaaaagaagagctcaagaaactaaatgccttcaagtttaaatgcctcattctgaaaagacgaagtgtaagagtgtgtgtgtgtgtgtgtgtgtgtgtgtgtgagagagagagagagagaaggagacgtgtgagaatacaacttttataccttagccacactagttataaccaaggattataattagtgggaatcaaaggctatatacaatgagctggatataaggccagtttcttcagagaggggagtggcatgaaaatctgtccaacacaggtgcctcgttttggatagtaaaatattgacccaatcatatcatcctgtttagggaagaatgaataggcccacagacagatgctttttactttactagagctttagttttgtctaatgaaatgagctattgctcatgaggctagttatgtgttccaggctttgaagtatagtactgatgatgtcccatgccaccttatttcccttgtgcatcattatgataaacccatttttaaggtagtctagaaaatctctacatgacacttgcagagaacctactatatgcatttgctaatgtttagtccttgtctttattctctttttatgcaatacttttccttatcttgaaaccactttccactaatatctatatgctggtgactccatgtctattctctaaagcaattttcgtgagtaccagactacatttctagtcttgttaacagaaccatctagatactatattggttcttcaatctcaacatgtcaaaaacatttttattttagttaatagcacagttctagttcaaatgaatgaggttttactacatttacactaagtatattgttctaaatggatagaataagaaacaatactgacatatagtaggagacattttgttaaaaaaacaaacacacttggataaaatgtatcaaaatatttacagtgattatctctgattgctgggatgatcttgaatctaatcttgattgtttcagctttcacttttatttaactgaatttaagaactttaaatatttcttacctacaatggagagaatgacaaccacaaaatcaaaaatattccatccaatggtaaaataataatggcgtagagagatgagtttcagtacacactctccagtaaatagcacaatgaacaccagattgatgcgtgacaaaatggtagtcacatattcactctggtcatctgtttccaccatcattgtgaccatgttaagacagatgagaatcatgatgcttatgtcaaaaacttgtctggttacgaagtcaaagaccattccttgaaatttgttctgtagagaaatagaaatgcttttaacaacaaaggagttttctcatgtgcattagcattaagtactttctgcattaattgactttctagtttcttgcaaagtagtcattggccctgatttttgtaagaatgatttatagcatattaattgttaaaatttagttatttaaattgccatttactaatgtgtatttctcagaataacaatcccttatccaaagaaggtttctgataaaaacaaacaaacaaacaaacaaacaaacaaaagaaacattcaacactgtatacttcttccagaggtatgcaacacatatcaacattttaagattatgaaaaggtaagaaacccatttaatttttttttcaagactttccaatgatcagctggaccatacatccattttaaaatatagtactattaatatttcacttgttgtattctcaaataattgttaaggagaatttggaatttccaagacacatctataacattatgcatttaaataccacatatggcaatactcatattcttctaccaaatagccttggctaacattgtcagacacagaatcctgaaactgcacaaggataatgagaccagaatgacatttcctatatgtttatgtcaaaaaaaacttcacgttctttgtcgttgatctgtgattctgcttcccatttctgccactgctagtcactgaaggccatctgcaggcttatttctttgggccactgaggaattctgagggaattttccaacttatatttttcctaaattgttgtttcatttctactcttagtgctaaattttaatggagaaagtatatatttctcatcattctcaggaaggcaatattcaatcatcacaatatgaatatttgctagtagttttttccttgatgcaccctaggaattactgaaacctctcagatcatcatcataaaaatatttatagtgtgggataatagctgtacattttcatagcaatttgtttatttcatcatggaagcatgagtattgttatttatcatcataaactgtaattactgaccctgacttctgcagacattagtaatacctaactctatagccatacatatgaatagtagatactggaattctttcctcctttaaaacacttagtatctctagtgaaaaataaaatagaagtaaggtgttatttcactcaacacttcatttcttaaaatattaggaaattgcatttcttacagccccatcccaaggtttacttctttccctgatattacttggcaaccattcttgagttgtgtgattaactttctcttgtgcacatcacattgtctatgtgtccattggccaattaatatggattgtaatggggtgcttctaaatctcttgaagtcaagggtgtatcttctatttcttcttgttcttttttggtctttaattttttttgttgttaccattatcataaaagatacaaacatcacttttagatgatgctctacaagtgaaagaaattttttctactggaaatgttagctactttcttttttgtgagacaagcatgcaagtttttgtttttgtatttttcccccatatcatttgatacttcttactcctggtcgaggtataggcttttgcggttttttcgatcctaattttttcattgcattatagtatttcttctgttcttctgtcataaagatgtcttgacctccaaagtatagaaaagaaaaatcaaactggttaaaactgtgtccttttgtacatttttttcaatgttaaaatagaaaatggatggctaaaaaaagaaatacaaaattcaactgattagtataattatatctgggatttaaaatgtaaaaaaaattgtactctttaggtatgataatatttaattccctaaataattcaaaattgactttattattattatcttatgaagacaaacacccccaaatctcaaaaaggttaagtattttacccaagaccttatgcttagtgagtggcgaaatttggttcactgagataataaatacttggtaccttatactatacatactacctttatgatgttaaaggcaataattttcttatttaaatgtagcaaagagttagaggatgtatactgcaagacagtttggagttactcattaaaaaagtcactctaactctgtcaagaattggaggaaagggataaaaagaaaactggatgagttagtgagagatttaggggataaatcagagctcatagcatagtaagtatgggacagaccagtagggatagaagattggaacactggcaagtaagtgaaatagagtagcctgatattgacttaagaatactactggtaataagaaaagggaattgaggggagaatgttctgtagtctaagaaagcactcattcattatacaaaaagcaaacctactgaacaagtgagatgaagcaacagtacataaaggaagaaatacaaatggccaatgagcatttaagaacatgttcaaatgtaataaaatacataaaagtcataacaattaaggttataaaagtcataaaaattaaaattaaatacagttttcacctattaaatatcaaatattcaaaaacagaatgtttggtgacagtgagggaacggtggcatgggtgttcatacactgatattgggagtttgagtagttatattactctaggggagtaaaatacttcattgtgggaatttattctcaggaaataattaaagccttattttctgtccctctctctttttttttgtacaaaactttcaacaaggtactatttaaatcattaaagattaaaaacaatctaaattatcaacctactggggaatgaataagtaaattatgataatgcatatatgaagacttaacaaaatgagaaaatacttatgttaagtctaaagtggaatttataattatagataaaaagtacaacaataagagtatgtgcagaaatactctgaacagaaaacaaaatgtgaatggcagcagttacttccaagtgatgatatttatttactttccatatgttctataatgtacataggtaattgggacaatcaaatgagccttataaatgataaataatagtcatacaattcaagactgaaacggatagcttgtatttaaatatcttggagaaagaaatgggaatatataaaagaaatcaatgacagaaaaaagcgtaaaaataaacactagaagaagcttacatccagtgcctaatttattgcaaagaattagttggaaaatatattttcaagggggagtgggtagttgtagggataaagtaacaaattgcttttgggaaagaggcatattcggttgctttctagttttattctaattattattttttaaaagatagaaaatgtttcttgataatgaataagaggaggaaaaactttatgaacctatgaacaagagtgtggaacacagttattcttagctttctatagccggaaatatatggatagtgaatgacagaggaagaggaaggaaaaatcagttataatatatactcccattttgtttctaaattcaagtactcatttggcagagaaaacactccaaggaataattttctatctcagtgggagagaaaatattagaaatacttatcttctttttctgctggttgaaattatctatgatgacaccaataaacaggttcaaggtgaagaaggacccaaagatgatgaaaataacaaagtaaagatacatgtacagactttcttcatacttaggctggagttccacctaccaaaggggaatattttgtaaaatattaccatacattttagtgctggaaatgtcactggtgctttttcataacaatagaaaaaattattcttactaatatgtcagcattttttttttttctgaatcaactacctctaaaaaacatccctgaaattggcctttagggatgttttcatgtgaaaaatatggctattatgacattctaaaatctatttttataactataaatacaaataatattcttccatttgaacagtaatgtgctaaatttgcaagcttttaaggtactgaattttagtaattttaaaattattaataaaaaatttaaaactgtaaatatctacaggctaggtttagaaacagtcattcatgtatgcatgaaataatgtagcaaataagaaatgagttgttcattcagatgtttggcactttaccctaaagtaacagttattgaatttttcagattaagtagacatagatggacagtccattttataaatcctcagttgattatttaattcctagattgtgcttaaaacaaatgggctattacttataatttagtaatggactgaaaggtcactatagttttttaacagattcatgtccttctaaaagcaacaaagttaaaaaccaactaaacacacaaaacaaaatataagtgacaaagtgaaataaaacaactctggaggttatcaaaatgatattcaacataaaactaaagctatttgaaatgcacttcaagaaagataacatcaaactctatcaggttgaagactgcagggacagaggttattctttatgatgataaactaaacagatgggacttgagaatagaaagatgaaggttgatagaaaatactacatcttacaaagttttgaagagcaaagttggaatgagcatgaatttcagtttaggtcttggagcctgaaagaggctgaaatcaaataaaataggtttatattttggtgatatacacttaaaggaatctgttggtcacagaagtgattgcaacattagtaaaggctccagtcaatttatgaatgcaaaaatcatataaaaacattcttttatatggtttaaaataggattatttgaaagaaatcatcacagtaatctaaggctgacagaacaatatccataacttttcatgctgtctaatatggagggtgactatacatttcaactaatgatagaaatcatatatttcttcaaatttggtcccgcacactaaaattactactaattatataatgtgtggataaataggaaacaaaatagaaaatatttaaaaggaaaatatttgttagttactaaatacatgaatttgttactttggttttcaaaataattcatgtgttgaattatcttagtaagatctttctgataaacattgctatgcttgaatatttacctgtcacactttttcccaaatattttaaatcaagatagaatcatttcatttggtcgtttatgctttattcgattaattttaccacctgatcaatattgtaaaaagacttagaatacaaggaatacttacatttctggaatcaactgctgcatacattatatccatccatcctttgaatgtggcctattaagaaggacatgcatgttttactttggagtaaaaataatttagacctgatgtttaataaatattcttactgatataattttcaaaagggaatatttttgaaagacatttcaaaacaaattttacacagattttggaccaagacagtattttagtatggcttttcatttctagaacacatattgaacaaaatggccatttgatatatcctccccttgataaccaactcacaagcacttttcaattctttagagttcatggtgtcatgatatttaaagcagtattaaaatttgctggagcactttttagaaagtcttacaaatgccaacacatgggtcaatagctctatcagccaaataattacaacttagatctaaggatcatctgctaaaatttatctgcagggtgatcaaagtgattgaaaatttaagatttctctttattgtaacaatgtaaggatagtaccaggatacataaaggcagggttgcaactatccttttaagaattttggagcaaaacatttagaaatacaatccttttaagaattttgcatcaaaacatttagaaataaccccctattctattttctttctgaaattcttgaagataataagttaatatgaataagaaatgtgaacaatagtacagcagacacttggcactcacaggatgaaggatactcaggctaacaacttacagtaatttgttacttgtcctggggcatgaattttgagtcctgtgggcctaaaaggattatcccttagctagtgagggaggttagcaaagcctttagcgtctgtatcacaatatatctttgttctgataacgctaacccttgtgaggtggtggatttcatgagacaaaagctaagcaagggtgtgggtgacagcagtgaaaagaaagtaatgattcctagctagaaagtacaaggcttttgtatatgaaagagagagagatgtgttaaatatgtcagtggcttaggtcaatgatagaacaattccattacacacttggtatagaaacaaaaaagtgattcaagggaccatttcaatgacttactaatcaatagagaggtgattctataaaagccaaatgtgaagcagtattttagagggttttttttttttttggtggcagaatttatttaatagctttgtgcaggaccatcactgtattttcagaattgcttacattttaaaggattgcttaaaatttttaatttttctttcctcaaatttatggaggaggtggttgctttagtgatatttacaagtatggtcattagttaagggttagaataagtgcccaaataaatatcatcatgtgtcgacaatttttaaagaaagcattcttgctagattttttttaacttttgtttttatttgtctttagagacaaggtctcactatgttgcctccactggtctagatctcctggcctcaagcaatcctccagctttggcctcccaaagagctaggattacaggcatgagccaccatgccccacccgttcttaccagatttaaaaaatctctattttaattgcatgaatattattcagagtagatcaaaaatgttaagaagagaaataagaatttccaacaaaaaggtgggaagaatttgtaaagtaatcatagttgacacctctggaagagctgcaaaagggttttgaccagtgttggtttgtttgcttagttagtcttctggttgaacagttgaaatcataaccttggtgagcaaaaattgatttctgccctaaagacactgtagaaccacaagggaagaaagaaattgtacagtcttttttttttaagctgagttttcaaataatctggactcttattttattccctgctttgttgtggtgctgctgcagctagaagcagaatcaaatgaaaatgtttaaagggctaccttttttaaatataaattataaactatttttcttggagacccagtcttagagacccagtagtgaaaacattaatatttaggacaaaatagacttaaataatggtgctgaaaggtcatttgagataagacaacagctgcttttgcttcatttttgtttctagttgcttccaggtataattctctctctttttttttttttttttttttttttttagatggagtttcactctttgttgcccaggctggagtgcagtggcacccaccgctatgcctggttctaattctaaaacctaaatgtcattccccaaactttgatccaaataatagaactcagcagcagttaatccctaccaattaattacaatccaattaggtgtattaagtgtatgtgttttggaagatgatctatctgttaagtgtattccgttttggtagctgatcagggaaacaagccttctaatcacaataaaaaatggcaaagttactgatttattaatttacttgtttatatagaaagagcaatatagaaacaaagaaaatacaagaaaaaagacaaagaggtctttgtttggtctggtcactactgactatatctgcagtccttacatgtaataaagttttcacccatctgggctcataaacttgtactaacaaattgaaattttttaaatagaaagaaatatatactttttcttaggaactaaataatagatgtatgtcattattttgttattattccaaacaataaaaatattcagagaaaatagtgttcacttacaacttgaagcaaagagagatacccaaatcctacattatcaaagtttactttcacatttttccatcgagcagtctcatttctttctattagttttaggcaatcagtatgattattcacgtcttcgatgtcaaacctgtcaccagttgtggtgttaatacagtggtagaatttgccagcaaacaaatttacgcccatgatgctgaaaattagccagaatataagacaaaccagaagcacattcatgatggatggaattgctcctaaaagggcattcacaaccacctaatacacaaatggaaaaaaagaaaagtcagaattcttatctgttaataaagaaaaaaaattcccctagtaatctctggtctttccattctttttttctatcaatgctatttattctaggatatgtaaaagcaaggttcaaaaaaatcttaaaattcatttttttttcttaagcaatacacttaggaaaacaactataggcaatataaccaagaaatgaaacaaaaatgtttttaaaaaaaagggagggagaagcattaaaaggttaaaggaaaaggaaaatcagaggaacttgctgccagatgaagtcagaattgtgttatcagaataaagaaaagttaaaaagcctatacagaagtttaactcattttaaaaaggcaatatattaaagaacaaaactaaaacatttggacctgagttgatttgaccaatatatttttaaaataacttaaaaattcagatgataaatataaaaaatattattaaatacctaatataattgtctttaattattcatgcattgctatgactaataatttttgcataagaagcaagacaatttgcattatgtatttcattagatcatcacatcgtttatttcaagctccagtcatgtcagttgtttcatttactgagtttaattcaaaaaacttatttcaaatgaaacataatagaaatcatttcttaggaaaataagaaaaagagggatgccatacatagttctcaaatctgatgtgatcacatgaagttctgtgttcaattattatctacttttttttttttctatagaaggatgttttccccctctttacttctggaccactagttaaaaatcttgagtgttcatgtttggaaacaacatagggatggcttccttgctttttcctccatacctcccactggagctgcacaggagtggctaagagggaagctaaaaacagaccctaaaatgcttataaggggcagctgcctcaaacttggacattaatagctaagtttaattccacctatgtgcttgtattattcttgtcagtctgatccaatggaagtagtcgtcaaaacatcttctatttgccatttgatgccagtgtatttttagaacaattttttttaactgcctgtctgaaaaaaaaatacatgagccaatttcttatacttctgatccctgtttaaagcctgtaaagaactctaggccttctggggaacataaaacagtgtgataagtgggccaaagaaaataagaataccagtaatgacaaaggtggaggggatgagtatgaaaaattaatttggttgagttatccaggcagaaccaaatgatgtggccgatgcaactaccaagctgacacgtgacactttgccttatctcatctgactgtctgcattaatacaatggacttcataaattctcgttatataatttattttaaatggatgaatagaattagatttctttcagattagagatttggaaattgaaatcaagttactatttcccttcttttctgaatattttgtccactatccagattacaatgctgtttctagtgtgtatacacagagtactaattaaaatacgtattttgccttcaacacccaatttagagtatgagcagaacactgattatctatacctatttctcgattttcttttcacattacctgtctcacattttttctttgaaacgtttctcagctttgccacctcttttccattctcacagtcaccacctagaactgccctctgttatttcatacttgcactgtcatctgtctcctaaccttctccttcatttaatctatgtaagatgaattaatcttccccaagtcccacttgaaagttatttattggctctctggtaactaacaaatatttttcttaccttggtattcacatcactccacaatctatatttccagttttaacttccctggtcatctatacttcatgccacttcaattaatataataaccgtgtgctaatataattgccaggtgattgagatgccatttacattgaaattccttgtctaatagctcctcttctgaaatactctcccctcttaaaggctttagttcaaatagcacttctttcatggagcctaactttgtcccccagtttagcctccaaaataaagaggaatgttttcccctttgaattcaagaatcagaattctagtactgaacagaactgtacagataattcagtattgcgttctcatttggcatatgagaaaaatgaggttaaaacaagttaagttcagaaagtagcctataaatagcatttagtgctgtttccagtctacgtggaagagttgctcccacttatctggtacccatattactctgtactagagttcagtgtaatcctgacagattgtaagattttctaaaaatttaagatgcaaacatatgttcgtgaatcttccagggccttgagtgtcttgaatataagaacataccagagagctttgaatataggaataaaataatggttgacaaaaatgaatgggttaatgaagcaaagtttagattagtatttattgatcaaagcataatttttaaatgttatttctgaatatgggatgagaataattaaggaactgagcacagggagaagtttgtgcttaggtaatatgtttgagaggtttactttgaaactggggattgatttagagttaaagcgaactctatggaatttatgacgcaagcatgtactctgcagcagtgcacttcaggatatgatttgcaaagttggcatacatttggcccagagaaaagttttattttttttgtgaacataaaataactttatcttagaaaacatctggcacagtattggggagtttattatacaaagctatagtcatatttatgatgtattaaattagacaatgaaagatcatagaaaagattgtcttttcccaagagttccaagccattccttggttcagcaaagaaggaggtgtattaacttttttcagtctcaataaagctgcagtaattggttcttatggggggaagaaagtaggcagaattagtctgaataaattggaaagaacaaatttcaaattgaactttcaggctacatgaaaggaaatgtctgagaaaggagctatcttaatgaattaatactgtactagaggttgtttcttctcagaagcttttttttcaaaacaatcatcaaataaagtttctctactctagcacaaccaattctatttctggttcattacctgcatttttaaaaataagtctacactaaatgaaggattgataattaaatatgcaaattcacattagaaattttcatacatgcagaaatgtctttttatctgaattaattactttgaacttcaaatcaacactattcatgaattctagtgcttctctaatagaaataaagaaaatctatgtgaataaaaataaaagtgggcaaagtaggaatcatccatttttaagtataaagaagaataatagaatctttcttaaaaatctaaaaaaattatgttgtgggttttaattaagacagtttttttgtaagctatgatatattggtgatccaaacaaaaattctgactttttctgtctctcgaatataaactcttcttcttgtataatacacttaaactttaagaataaataaaatgtagagttatgtttatgtatgttttcactgtgttatgttttaaaatcctagaaagttagttgggagttacttattctaagaagtgagtttatgccttaaattttatcttaatactcatgataagacgtttttgttttatttctaggtatgtattctattctgcataattcaaataagtggatttttttattctaactttttgtttacaacacaattcacatgtgcttattcaactatttcttaatatatttttgccttgttaacattttgaaaataaccccatatgaacttacacaataaaaaatgagagtggtcacaatcaataccagtcttatgaaacctgaaatattgcaccctagtatctgctcatacatatcaataatcaactgatggtatctaactggtaattttcaggacccagaccaatgtactaaacagcaggggctgtatgcctcaaacagtatcatgagcttaacaagttaaattgttttttcacataatcattctacaccagggtcccccgccctcaccaatccagtaatctccccaaagatggataactccatatacacataactaaatcatattcaatgaaacttaataaagatatcaaccattggggttaaaatccacagagggtaaattcataaaggtttttttttttttcaaatgaaatttaagacaattgaaaagaggggattaggatgtaaataatgtattttccctactgtggtgcaataatagtacccttcccaatccctccctcaccccactacacataagtcacagtgcaaggattaaaggtagcaaaaggggtaatacagtacccataataaagggctcaggggaggaaccagcgctccaccccatccaagttggagcaagattatcctatacaaaatagaaatatatagtttgttattagttagaaatctgatatgacagaacatttggtgttactttttgttcatgatgctctccgtctgtttccctatccattaagacttgagttcttttgaaaaagaaggtatttaagatttcctaggttaggaaattaaaaatacaaatttaaacacaaattttattttaccctagatattcacgacatcaattcactcagtttaattttacaagttgaaaaatttggactggaaatttgaaatacaataaatgtttaaaagctgtcagccagaaatgtgcataaaacatgcaaaacacaaagtgcaacgtgatgataatttatttgttactttctaacttcttatcaagcactgtacaacatgctttattcagtaatgttgcataaaagcacatgctttgaaaaaataacagaacaacaaaaataaaatgagtgcctgagttacgctttgacgcagctattgtgattttatgctgctagggcaaagaattaaatgagagtttctgagcatgttcaaatctcacttcccaatcataatcatcattcttatatccaacctcaccatcattcatgattatatttttacaaaataaaatatccaaacactagaagtataaaaaatagaatcaattataacgttattttgactctacaatgccaaacacgtattgaagagattagtcattttagtgctgtgtgtatgttgtcattatgaggaatagagccatattcataaatctgaccatttaaactattagttatatcactatcagcatttataaggattttatgtctaaaactccaagtttcaaaaactaacctcttttaatataaaaggcattattgattaataattatagatatggttatttctgagaaaattaaaagtataccgataagatcagcttttttatagaaatgaagtgtaatgtatggaaatatctgagcacttgaccaatgaatttaataaactttcaaatggtcaaatgtaaaaggtttataatattttcaaatgtttagcattgttcagatttcacaagccatataaaatatattattttgattcaggcaacatgttttcaagtagaatgtacacaaatgacattttttttctccagaactgaaactgccagtctgaaacaaaacaaagtgacatttaattggaaaacagacttaattcttatacaccccagagataatttctgttaacattttggtgaaaatttgaggctctctgtgagaaataaaagaggactacttgtattatattgttctgagttgtcgataatgaggacaaagttttcatatatgttagggaaatcgaagacaagtcctacgttcttacaaagtgacatttataataagacttgagaagagaacataaggctataaacaatctacaaagtgcaaatggaagtctacaatacagcttagtttccataaaagtaactacaccttaggaggtgaaagagcagtgtttttctattggaatcacacaattcagtgttttgttttgataatatttttttttaaaaaaaagcagaactaattttttatattatatatctataaactaatgcttcatgccgtaaaaaaaggcatggaaaataagtcaataatggcaaaatttctaatctgttatgcatgatggaaaatgattattgcatctttgaaaaggataaaataacattttgtgtgactctgaccaataagatgcaagttaaggttaatgtataaattacctatagtaatgagtcaaaattatattttctgttcattataagtgttttactttattgttataaaaatgatgtggatttgtatgtaatctttaagttagtattactagttttataaattcagtcaacacttaatatctaaccatctaatcttgaatatattcaaataatgcaaactttggcattatacagacaaaagttttaacaactcctttcatttttttcttaacactcatacttaggcacatgtgtgattcacattattttcaggaaaactcgttaagtacagtatatcatcacaaagaataagtacctgatatagaatttactttagattaccattatatcattacacatagtactttaataatgcatcagcttttttttgtatatagatttgtaaggaaactcccaagatggattaggaaataaagtcatttaaataagcacagcagataaatgatattatatcatttcaagagaggcctatttctcttgcatatcacctagaagtaaatatgcaacagataaaacaataaagtagcaattttgcaagaatttgccattccttttgcatgcatagattttcctttttctaaatttaatttagtttaattttggctatatacaatacttcaggttctttcatttttcttaccctcatcccttcaaatcgagataaggctcttagaggtctcagagctcttagtgtcctgagagatttgatggctccaagttctgagtaacccaaggcatttgctgttaaactgaccaatgaaacctgcacacacaaaaataataacaattaataaacagaatcatcattcaatgtgtagttgctatataatacaacaagtataatttttgcttataattattcagaggataaatgttcagacattttcagtaaacctttaaaaaattaaagaaataatttcagtttgatgtaaaggatgtaatttttaggacattaattaaaagctagttgaaaaaaaatccttaaatgtcatataatttatcaactgaataaatagaaaaaaaaagcaaagtaaaaattagtaaaataaaagaagaaatcaaggtggaaaaaaattcattggctattcttcctttattttattaagttgctgttgaatttaaggcttttcttgtagctagttataaaatacaaaaactgctgttgtactaaaaaaagcaggaagtttctactgtgcatcagtatattcaactaatcataattggtattctcagaaattaatgaactacatcagttttgaaggtgatattttgtcttggtaataccttgcattttcacttgtttatttttacataagtaacttagaaagaaattccattacaaaacttcctcaaaattttttatactaatttatggcttctgccatgatatctggccccaaagggccaatcaatgaatatttaccaaatacacacagcaataaatttacttcatttgtattcatttgtaggtaatatacatgactaaaggaaaaatcttacgtatctaattctctaaataaggaatttactaaaactttgtattcaaggaagattataacttatttggttagaaagatgctagtattggagaattccgcatatactgcacactatttttgtaaacttttcttttttaaaatgtattaattgtatcatatttaatatacttcttacattatttgagatgtgctgtaattagtccttttatagagtgctatactgatcttcattaaagaattaaaacagaacattgaaaataaagatattattgttacaaactacaaaattttctataaaattattttcttaaaatgtttcaaaaatgacactaaaaaactttcatgaaaaagctgatgtgtaataaacataatagaaaaaaaacctcaggaagttttaaagggttaaattacatttagatttaaattatagtgtaaacaattctgaaattgaaacataatgtaacttctaatgcttgaaacctcaatattacaaactttctcccttattgatgtgataaagcaattcttcctttgagatttctctcaattggctcatttcacagtaacattgttaagttttttaaatagcttagttttgcctttgttcagggtcaaggaaatataatgcattcatgattcttagctcaagaaacactttccacaagaaaccctcatagtcttgctgggttagtatctttttggggtaaaactactcaatatgaaatcaggatagttttgctgtagctttctaaagctgaaattttgccaagttgataatagaaaacatgatgcttaactttaacacatcttgaagtcagtcacttgttttcagtaaatgcagtattaatcattggggatacaaattctataaagggctgtttgggcttgccgtaaatctagtttacattctaggaaaactttcactgctgaataaagtagacttctctttccctacactctacataccttacttcctataatgaagtcataatccatataatctactatttaaatctactctttaaaaagtttgagtagatcaaatagaatttttttaaatgactgtagcacccaacagcatcactgtttttattgagtgcctttaatactgtacaagttgggggtcaagagtttggggccaagaaactaactcagtggcacaaaatcaacaagtgatggtcctgggatacaaacttgagtctgtctgactcacaacataaaggatttaagcaacataccttttaagttccctgtttcactactttccctacaaactgctgatgtgttgttttttctttagctttctcagataactagagaactaccatagattccatcccccaatgttattttaaatcagaattaaattagcccttgtcttccagaaatgacactctcattgcatatatgcgtttagtggttattatagtctgtcaacataacatagtggtctgagactcactattgtagaatttgaatataaataagacaagctaccttgaacagagacaaaaatatgaacgatacctacatcaacaattaagaagtccagccaacaccaggcattggtgaaatatgtttgatagccatatgccacccattttagaagcatttccagaatgaaaatgtaagtgaaaaccttgtcagcatattccaacatcgtcttaatcgtctttcgctgatcaatatatatatcttcaaatgcctataaagaaaatgttacacattattagctttcaaaaataattatactccataagctatttaaaaaattaatcatatgcatatgacatttcattggaataggagggcagagaaacagtagttactgttactttttttttttcctcgcaaaggtcttttacttatttaatcaggggaaagactattggtggaagaaaaagaaaagtatgattccaatgaattaatttgacttagtcaggaaatagttcttgatgttgtatcctgatgtggccatcccaacttgaagttatgtattccttttgtttcatttattttgcttccttctattggctttttttttttttttttttttttgctatagaaaggaggttgaagaaataatgaaagcttgtgcttttgtaaagcagaaattgtgattgatcttcgcagtctccaatttgactaaatagttgggttcatctgcttcttttttgttgttgtttgttatttttttaataatttatgtttctcaacagacatacagtgtgacaatgattaaatgaaattacttttcatttagattctaatatatattcttctattatgaacctctcgatgtttcacttctaagtatgcattcctttcaacggtgaaagacttctaaagtagcgtgtagaaaatatttctttcttcagaaaaattacaggtaaatatatgtctgtgttagaattataaaaagttaaacttgtaacacacttgcatttcaatcaggcaaactctgtttctctctctttctttctctttttctatctatggtatttcctttgtgttagtgtttccctaaaatgctatctgtatgttttatttatagttttataaataattttcctataaaaataaattgattctgatgaagtgaacaccttgttataaagataaacccatccttaaatgaatctcttgggcatgctgcccaatatttattgttaccaactttcattatttcttaagtagcacaaaaatagtgagcacacaattggaaaaagacagagaagtggtccctaaggacttactactgtccatcaagagataataataataaataccatttagaaacaaaattcgtcagaactcagagaatatatattcccatcccagggcttccaataactttttttaattaaacaatgagtaattgaatattcacatcctttggtgttaatgaataagctgaagggctacactttctgggctatttaatagtaagcaaaaattaatgattagcttcttaaaattatatttacatacatagtaaaagttaatccagaaatatagagttatagagtaaatctatagaagatacaaggtgggataattaaaaatgcattggatactaagacaatgaaacaaaggattaataagtcatcagtattagagtgttctaaaaattagtgctgtatcaccttttcttaatctcactcaccagagcaccactactaaggagaatcatgaaaacaatgaaggtctcaaaccagttatgttcaactattcggaaacacgtccttctcaggttccaccattgttttcctctgccttcttccacattgatttgacaacacttgaatctttgtacacagcctgcagaaagtgttgaaataaaagtagataaagtgtctctgcttccataatatcctttagcaatgtccttgtcttgtctttttattactatgctcatctctgtcttgctagcatagctctctaagcctagagtagtaagagcacattcatcagctgtgtgaagttgtggaaacattcagccactttaaatgatgccctagcggacagtatttgctttgtctgcctcacagtgttattgtccaagagaaactttgtaaattacaaataaatgtgaggtagcttttccttgtaccatatcatcctgttgcactctgttgaagtcactccagaaaagaactttaaattggacattaataatgttaagcagaaaacttcccttttataaaggatatagagtaaaaatgtagatctcttccaacaatgctgcatttgttaccatttaggattttttgtgatgtgcctagaagggcttatgtaatttgcataattaatttagttcactaaaagctaatttgtatgatttggctttgacttttcattgccttcctcacacattgctttcacttagtctaaatgcaatcaacaggtacttctgagtaccattgtaagcacaaaggcacttaggtacacacacaaaaaggcaccgaacatgtaccttactcccaagaaccttaccaaaaaaaatctggttttcaaaaaaaaaaaaaagaaaaagatataaatacaggatccctgctccaaggcaaaaaaaaaaaaaaggaggaaaagatatgtttgaagaaaaaggagaaagggaatgaatggagaaaaggaggaagaaaagaagggaaggaggaaagaaggaactaaggagtgaaggaatggaggaaaagaagagaaaaaagatagaaaagtaacatgtaactgttcaaaaagagaaagagttttcataggataatgtatattatcgggtaaattaaatggaaatacttcttacagccattcagaggaacaagctgctgttccaccatggtcagatgagggcagttttgaaaaggacattaagtgatatgcatgatttgtatagggaatagaagaagactgaaggtatactaggcctatgaaaaaataacatcaaatagaaagtatgcatatttccaaacctcaaattcccagggatatcagaccacaggaaatattagttgtaggaaaaacatatctcttctatctattgcccatactgcaccaggctcaactagtgactgtttaggtatagagtttctagggcagtatttattccccatttcatccaacaattattggaaactgatgttttcattaaagaaacacaatttagcactagcaatccgtttagttttagcagtcagaaagttacttttaaggcaaattctgtgtaggatcattttcagtagtgtctaagatgccaacttattgtgaaatcactacttactttaaaaatataagttagaagttttgatggtactaaaatatttttcctccatgttcttaatctcttccacatattgggcagatataatcaaagcatgacactagactttaagtttttttgtctgtcaacatattagaggtgattgaattatatctattacaaagtgccattttattatatgtgatttattttagctgaccaacagctaaacaagctgcactccaaatgaaagattaacattaggattcttttctttaccttcagtgaaacaagcttctggttcaagagtttcttcaggttccactacgggctgttcttctacaggtgcgccgatgtccacagtgctaccttctgatgagctactgctttcattcagtttctgtaagtgagatggacatagaaagtaaagtcctttaattttggtaataagttgcctgccaagaaaggattattactatgaatttgttttttattcttcttgaggtagagatatttttagagaaaaagagagattgaataaggggaagaaataagaaaatcattgtctgtgctaacccttttaccataattcacaatgtaagcttgaaatcagattgctatgttatgaggttacaaaaggccatcagccacatgtactgagcaaaacactgccttgtggattagagaagcaggggacacagggaagagaagagggaggaagagaaagggaaaaggagcaggagagaaagagaaagcttaccttagaagaaaataatgtcgttaggttattctgcagtttaatgtttgactttacatatttctttaacaatgtcttacctgtgtgtacagatactacctgttgttttcacttatgttactaagattcatggttaaggtgttcagagttatttactataaatgtggtcatttggagagaaattgttataaaatatgtcaaaaattacatcaataaacaaccttagagatattaaatagacatcttcaatttctggcaagtattttagagcctgaagtgttgtaaaatgagataaatagtgtgtgggaaaattcagtttcctctgacaaatcatgtttatgttaatgtgccatgtgaagctgaaagaacaaaatctagttaaacaacaacaacaataacaatatccttcatattttgacaatagtgatgggatgcacatttctctttctagagttctcagaagacaaagatggcagagataatagaaaatattaactaacatattaagataggaaaaactcatgacgctctttctgaagaccagcaaactggcttataagtttttggcaagtgtaattaattcattaatttattcaactaatattttttgaacaccaacaatatgctaccagctgagtattcactgataactgaaatatctattgtccttattggagtatcaaatctagtacagtattttctaaacttcaggcttatgtagacccgacaataggcattccagtgcacacagcagcaagccattcaacccgttatcacgatattgtaaatagtaaaaattaaacacaatattaaaattgttaatatgaatttcacatacataggagagtgttgatatttcagtaaaagtttcaccgaaatatttgtatttgcttgaagaaggatagcttatatgtctgggtccatatctagttgccttctttcctttccttttaatttcttaaaatagaaaaacttacctgacagttacagaaaattaggacctataatggcatgtagctctgtcatagctctgtgaattcaggttgaagatgatctttgaaattataaaatatttctcactgaagactaatttcaacattctaacacattaaataggcctgcatactatgctcagaagctgaaaagttgattgttcaacatgatagacagtagtaaatagatcataatctactttcgggttgcatttagctttgactatctttgtgttctgttctagcatttgcactgaatttaaaacatatccaggaataagtcattggtttcttcctctgacaaacgaagagaatcacctagtggcaggcgttagtcacattctcaatcaaactactcataacatcacatgatcttctgaagaaattcttatgtcttatcctcaacattacacagattcatcatttggccgtaaagtgataggctaagacttgtcacttcaacaagtgccttcatattttaaaaatgaccttgattggcactatccgggacataatgaaattcattacatactttataaaaaccatgtgagcaacatttcatcacccattgttcttcactgtagaaaagcaaatgcccattcttcatgaaacaattagagagtggaatttgagaattttaacaattttcgccaaaattaattaagaactagaaaggatattatttcctgtgaataaatttgtgtggagaggcattcaggtacaaagaattataatagcaaacctaccttctatatatataattgttatctgctaggtctgatccccacatagttttccagtctataccaagactcacaaaataatagaatattagcataaaaatctactcttcatcagtataggttgtcagtaataagcagaacaaaaagttgctcagtaattaatcttcatgtaagtgccacagataaatgattgattctttgcacataagtgttttatccaattgtaaggtgaattagatcctggcatgaacatgtacataaaaattgttcttccttgattactagtaatatcatgcaattgttattgcatgatattaaagtatactgatacactgataataaagtattgccaataactagttttgcttttttgccaaccatatttgttttcttatgaggaatactacttttaatgatacctctgaagcattgatttttattctgcctttaagtgaaaccacttattcactttatgaattaaagcattgttttttactttttctaagacaaagacttatctgacttacctaagttgtgactattttctgtgaaaattacgagaacccaaaagaccttatgttactttttgacacattttcaaaatggcattctctgaagaagacaaatagatcaacagttcaataagttttaatattcagatattcatcttatatttcttatttagacatttatttttaggatgcttacctaagatggtcactcttacagaattactttttaaaaatacatgtagatttatggttcttctgatgttttttcattagagtctcaattcacaaaaaaacctgagttttaagtttatatgatttccattcctattttatccctttgagttactcaaccaagatagtgtaatgatgatgtaacacaatatgagaataacatcaaaatggaaaattgaacaatataagagttggcatgcaattggacatacacgaactctaccctgtctactaaatgttaggaaagtaaaacttactactaattttaagtacatgagcaagcgcttgtaagtacccatattacattggtaactcttgaagaatgtagtggatattaataacataagattgtatgaactgtatgattgtatgaacattacaagataatatgaactctaaattatcttatatttaaaatatgttaaatgtttctgaataactttgctatttcatgaggactactttataaacaaactgggaccatgggtgggctgtagatccaggaattggtgaatagtgttacttctccaaattgtaaaacattaatggcaaagccaaagatagtcacaatggatggatacaatatacttctaagtgtgctttctttttttaatgcatagagcttggagtcactccatatttcagaaattttaaggtgatttaaaagatgatcaaatgcccttattagcattccaatggaatatctgcacttggaaagttcgcaggtctagacaagtgatcttctacatgtttacaaattaattttaaaacattttttaagcaatataagtatattctacagtctgtctgaactactgtaggaaagtggaggtgtgcctaataatactcaaatttagtatgctctcaatctaagtaatgactttttaaacaatcttaaacatacttctttaaccaaattcctgattctgcaatatcactctttcagcacccagactcaaatttttttgtttacttttacttatttcaaacattggcagtaatcaaaagtcagttttccttattttatctctgaaataactattttctcagtcagattccaaattcctatgaaatttctgtttattcttgttaccttttctttgtttaactataaataaaaatggccatcctcattctagcctcatgtgacttagacctttgtggtccacaaagcttagtgtatgtatggtgaatgactaacaaacatttggtgaatgaatgaatagatgaatacctctgtttcagatattagtgatggatgaagtttttgttttcaacttagagttccaaccaaatctcccaaatttgtctttcacagatagaagctgtatgttaatcaaggtgaacttcttttttttttttttttgagacagagtctcgctctgtcgtccacgctggagtgcagtggcgcgatctcggctcactgcaagctccgcctcccaggctcatgccattctcctgcctcagcctcccaagtagctgggactacaggcgcccgccaccatgcccggctaattttttgtatttttagtagagacagggtttcaccatgttagccaggagggtctcgatctcctgatcttgtgatccacccgtctcggcctcccaaagtgctgggattacaggcgtgatccaccacgcccggcccaaggtgaacttcttaatgttctctgactttttctcctagtgatttttcctcccatcattgcggaagagtaataattgctctcttatttaaacccctttcaacactttacagggactactttgggcatatattttattataacttctcttcattctaatggacttacttacaaaattaatgacacttgcagttttctcagtaaaatacaataactgatgaccttgatgtgcaaaaattgctcaggtcgttggctactgcctaggatatctgcacatttctattttcaccagctgaatggtatgcttatcaagaataagttatgtttattttcaaatcaatttacactattctaaaatactgtaagtgtgtaatttaatcttgtagaatttgaaaaatgcatttaaaaagtgttgttgtatttataaaaactaagtcaaaatcattgaataaacgtaacaccggtaaatcccccacatagatacatgtacattaaaaaaccataaaattaggtgtgaatatttactttttaaatagttacaaatataaatttctgagaagatactaaattcaggttgctttatatgattcgttaagatatttgtcctctgggggaaaaaaaaaactaaacagaaataatagatgatgaattacaagtgcagctcatgctaaaacattgatgtagcactccaaacaatgaacccatgctggaacaaggcacctaaagtgacatttttatacatgtcatttttattttgtaaataaatggagcagttgaatgtttgggatccagagaagtgtatacatctttcaggaacaatatatgattaaaaattagatttaaaaaatggtattcatatttggcttaagctctacttcgcaagtcagcattttgcaaagggaggctggtaagccacatcatggctaacccttatgatagaccctgattctcataatagtaagaagaattttcccctactttcaaatcataataacatcagaaaaagtgacatgtgactattagaaagattaaaccataagcagtggggcttatgtcaatgaattactctagataaactatgataacctgagagaagtgttagtgctttttctagaaatttatatataatgtaaataaatgagcattagtgtaagaaaggaaagaaaaacaaacaaaataaaataagttcacaagtgaccgaactaaactgtttttagccaaaacatggggaacaacaagagttttgattggcatgttaaataaggaatacaatacagaaattaaaattaaattaaacaaatagtaaaccttttacatagtcaatagattaaaataaataaaaacattaatataaaagtcacccagaccttctcaaagatgatagtaagtttataaaaacaagaaaggcattaagcttaaacacataatttgtataaattatttctaaaatgctatatgcttagtctttaatgtactttagaacttagagaaagtctatcatctgcagatcataagttgtacagctaaatttcaatcaacaattataccaacattcagtatgtatgttgcaatgaaaggcatctgtcctactaatatgacagaagaggtgtttccagccaatgttctccagagatctcactccagccttaagtggctgaaggctttaattcaagcagggaagttccactttcatctaatttatgcatgatacatgaaaaaatttgattaaaatattatttaaaagattggaaaactccctatagtcccagctacttgagaagctgaggcaggagaattgcttgaacttataagtttgggaacaatttcagcattatagctggatcccatttctaaaataaataaatacataaatgaaaatttaaaaaattttgaaaatgtattggaaaaccataattgaatcaaaatttggggaaatgcatgcccaaatttaagaagatgatgttaaatgaaagaaaaaatatgtgtggtgaatataggggaaattatgtggaatttagtatcatgaatttcagtggaaaaaaggtgataaaatgaaaaaaatcttcaagatttagcaatttcagatgaaacaacttggcactaagctaatgcaaagagctattattttaaaaaggctcttaaagtttagaatttgtcaccaacaccactagtaactaggtggggggcggggtaataccaagtgaagagacagtatctttgtgggtattaaaaaagttatttcaggggtttaatctataaacttgaagaattgacagtatgttgaatgacatgtaagaatctcttctttatgtctgcaaacatgctttcttcatgacagtctgtagtaagcagaattctaagatggtctccaaaatttctggccactgttgtcatgcccttgtataatcccctgcccttatgtatgggcaggacctgtgacttgcttctaaccaatacaatgtggcaaaagtaatgggatgtcactctggtgatcatgtcacaccgaatcattttagaaaagttacaatgttttcttttttcttcaagaaataaataattagtagttctgactttttaatgttaagtaccaacaaccaggcttacagaagcagcaaaatgtgaaagctttgctacgtgaaaacatatactaccaatcaggtaaacttgacaaattatactcaggttttttactagaagctgagaggagttggaattgaacatgacctcagaaaactgcaatattcagattggtaaagtagacctggatagtataattgatttggcaaaaagcacacaataggttaaaaaaaaacaaactaggatgcaaaattctcaactttaaagctctttttaaattcaacatggtgcctctatgaatattttatagctatacctcattacaataagtatgcatattggtcattttatttgcatatatgcagaatatgtgtatacattatcatgtggtaaaatgatccatatatggagtaagtagatgatgtaaattactttatacagccaaaccacatctgtcactcaccatttctgaattgactattccaagaacttttaaaacaagttatggcctccagtggagccaacaaccttattttttcacccttctcctggcccaggccacagtagtggaaagaaagccaccaacaataaactggaaagaaacccagacctggtttgacctcttactttctgcgtggctttgctcaaataattcttcctttagcccattttttaaatatgtaaaatgaagagatgatctttaaagttccagctttaattttctatgactttgtagtgtttgagaatttgaaatgatacatttggacagtcttaaatccaagagagatatgaagtgaggactgatgagaaggtgatgagggagcagatctggactcaggaggagaaaaggatgaggaagttcagagtgggtatggctgctgggcctgcacagtctgggtaacatgttgggactgtggctaaaaaagtcctgtgatcagtctggtcaacatagtgagatcctgctgtccctactaaaaaaaagaaaaaaaaatgatgtttttttttttgatacggagtttcgctcttgttgcccaggctggagtgcaatggcgcaatctcggctcactgtgacctctgcctcccgggctcaagcgattcccctgcctcagcctcccaagtagctgggattacaggcacctgccaccatgcctggctaattatttatatttttagtagagacagggtttcaccatgttggccaggctggtcttgaactcctgacctcaggtgatccacctacctcagcctcccaaagtgctgggattacagtgtgagacaccgcgcctggccaaaaatttttttaaatagctggatgtggtggtgcatgctactttggaggctgaggtgggaggacggcttgagcccaggaggttgaggctgcagtgagctgtggttgcgccactgcactctggcgtggatgaccgagtgaggccctgtctcaaaaaacaaacaaacaaacaaacaaataaataaatgaaaaatcctgtgatcatctctgaccaaggagaagcaaatagctattcccaccttagagacaaagaaaccatccacatgtagctgggcttttaatttcactattagctgtatatgaaatattcaattactcaacatttattgaaagataccatgttctgagatttgtgttaagtatctgtctcatggatctccttcatcagcataatgcattatttacctgggtttttgttttgttttccttttcatgttttgcttttgtttcttcttttttattggccaaattgaaaagcagaaattacactaccattgttttgatattaacttatttgataacaattaggagtaatatttcttaaggtttgtcttccagttatattttttatgacttgtctcttttgactattatttgtttgtttatttgagacaggtctcattctgtcacccaggctggagtgcagtgatgaagtcacagctcactgcagcctctacctcccaggttcaagcaattctgcctcagcctcccaagtaactgggactacaggtgcatgccaccacacccggctaatttttgtattttttgtagagacagcatctgatcctcaggctggtcttgaactccggagctcaagcaattcacccaccttggcctcccaaagtgctgtgactacaggagtgagccacggtgcttggtcttttgcctatttttctattggagtattagtgttcttatttgattgcaattgctctttacacatagaaaatcatttgagttttcctaacaaggattatttgccaaatgtatttgttttctgtgtctgtgtaacaaatgagcatacacccagcatcttaacatacattcaccaactcacagtttctgtaggtcggaagtctggcactgcctagttggattctctgctcagggtctcattgagatgatgtcaaggtgttggctggaaatccagttcttttccagggctcaggatcttcttccaagtttactgtcgttggcagagttcatttctcataattataagactgggcttcctactttcctgccagctcatggcccagaaccactctcagcaactagaggccacccatagtctctggccacatggctgctgtatgcaatttacaatatgggtgtttgcttttttctaggccaggcagagcatatcttttcagcttcctctatgtgatagcaggagaaatcactgtgcatttaaagagtttgcctgattaggtcaggcccacccagcatcatccccctttttgtcataaatgtaatgtaattaaagggtgataccatatccacaggttccaaccacactcatggagtggggattatacaagggcaagtgtcattgagatcatcttagaattctgcctgatacaccaaagtttgtgtgtcttactgatttttttttcctaagaaccataacctgttataccaatattgtctgctacattgataattcactattttttctctttatgtatatcttcttccttttttgttccttttctaatttctcaaagatatttgttaggttctttcatcccttcttaatcatattagtaatattaagtcatattaatgactacttggtcttcttccacaaattttgacataaaatgcttttatttttgaaatagctattttggtattttattatgcttttattcaatatttgtttaggaggcaatttcttaattttcaaatggttggaattctttctatcaatttattattaatttcaggcttaactacattgtgactggataaccctatatgccagctattttaaatttattgagctttactttgaactccagtatatggttacttttatagaaatattccatgaacccttgaaaataaaaattttctgtaaatatgttttttgagataatatacagtcatatttacttttgctattaatattatccaaaatctaaatgttgtcatctattttttaaaatattttaccataggctaaaaaagttgtattaaaaccttcataaccagtatatttgcatcaatatattcttataacggttgagataaaagatgaagtggtccaattctttatttgattgggataataacactattattattaaatactcaaaaagggaaggaaaagctcctcttcagatgtgtaggaaaagtccacctctatgttagcacatgaaatacgaattcatataaaattctaaagaaattcaataacggcaaaactaaaatattctcaaataagtatttttacagatttaaaaatcagtaaggccaattaatttttccttttttgttcttagattgaaatttaatttcattttgaaatttgctattcactaataaagtaatttgttctcactgttttagagattaatggaatatttctctttctttctttcttttttttttttttttttttttgagactgagtcttgctctgtcgctcaggctggagtgcagtggcgtgatctcggctcactgcaagctccgcctcccaggttcatgtcattctcctgtctcagcctcccaagtagctgggactacaggtgcccaccactgcacccggctaattttttgtatttttagtagagatggggtttcaccgtgttagccagggtggtctcgatctcctgacctcgtgattcgcccgcctcggcctcccggaatatttcttaaaatctattttaatgtttattaaaccatgaatcaaccttaaattttaccaatttctaaataggctagtttatttaagaatatgtatattttcacacatgaatcttaatagctaaattatacacttatacactgacttgtatcatccatgtatttttggcaggctgacttaatatgtgagctgacagaatgcagagaccacgttgtatatgaagcatccactttgccttgtacaccagggcattcaataaccacttaataactacaaccctgatggtaagagcagttttcctccgcagtggatttatgcaaatttcttgttttttaacaatgctctttactatagcaaatgattttgaccttgagggtaaggcaaaacaaagcaaggcaaagaaaactttcttcaatattctctgagagtaagtgattaaatgctttttttcttgttctctgacttgatcctacaatgtttatatttttatttttaaacttggtttgttataaggagcttatttatagagtttagtaggagttcaaattataataagtaatataaataaatctggaatttaagggtcaaaagcatacttaatatgtggtcatgcgatgtctatatatttgtatatgtatatatgtgtgtacatatatatttaatatatatatttaacatacacatgtatatatttaacatataaagaatattatccaaagtacttatttttaaagctggacaggtactattttaatgctgggtactttactattgtgacacatatatctcctaagtcatgctaaaatgaggttctctacaacctcagaaatgctagtattaatatttcattgtgtacattgtgcactagtaaatatttctattgtacactatgcatattaaaaattaaaatgacccctattaaagactctcaacaaaggaaaatataatatcaatggaaaagacactgtaatgagactcaacatttccacagggcagctagaaaactcaaatattaactcattaattcccacattattcccagttgatttcttcatcaagctgtatgttgaaaggacaatcttcagtgattattcatatttacagaatgtcagttgtttctattctttagtcaaacacttgcccagtataaaagtgaacgtggaggaatacggctctaatatactactctgaattttgctttcgataggtcacacataaacttctgtatcaataattaaatataagggaacaaaagcaacatatttcagacatattgagtcaatagaaaatcatggtaatacaaaaaaattggaaagaaaacaaaaaaattctgaaaaattgcatttataatccccaagctagaaaccaaaatgcaaatcaaatgagtaattttcattgttaaattcattttgccaaattgagcacagagcttctataatgttattttgacattgatttttaatgttaaattataacatacttaataagtgtctactgggcaaataaactgtatatctatataatgaaagagttgaaagtactactgttcagaggatcagagaaacttgagtttgaatcacaatcactggttttatggactttaaccaattattctgacctccttaggctttaggtttctaatttgtaaaatggttcttacttcacatccttgttataaggactgaacaagataacacatgaataacgtttggcgtatgcttatttgataaatggtaacaatttccatcacagtattgtattgtttgtaataggtgtaattattgatatttgaactttttcactaccaaaaatgtgccaggcatcaaaactaggacttgaaaaataaaatagtgaacataatagacttagtatctgccctcgtcggttcacaatcagatggaggatacagagaagcaattgccacacactctaataggagtagtatagagtatattgagaacaccacctagctcaatctaggaaggacagggtagaataaagtgacatttgggacaagaaggatgtggtgggtgaggatgagtcaggtgaagcaggatagagtaagagagtattcctgtcagagagaaaaggtataacgatgagaactgataaagcatagggaattacattgaatgaaagattagtatagctgggtggggaggtgtgaggtgtactattccatgatactgaaggagtcagcggtggtcagttttgcagggacttgtacccatgttaagtagtatagactccatactgtgagcaatgggcaactcctgaaaggttagggaggacagaacggttacgggatttgcattttagaaagaccacctattgttttgtcaagactacactagcgagaggagacccgtttggaggctgtagcagtaaaactggaagatgatggaggtctgacactgggtaaaggccttgggaatgcagagaggtggacaaagataggtagctttggcagtccctagtgatcaattagaagtagtggagatagtactcttgggttccatggatagtactcttcgcagagagtagttgccatctcttagagactatgtgcttaggttggagattgtcgtatgttccttaacccatataacgtaagataaaagtattagatggaaaaatatcagcaaagcaacaagtagatttaaaatgcatatatatcagtgatataattgggaaaaaatggaaatctagaagtaactgcccatcacctatttattcattcatttaataaatatgttgtatgtgctgtggacttaagggaagacagggttagtgtttttcctgttctcaaagacctcataagctaatgatacatcatagaagttcttcctaatgatttggaagactcttccagcagctttaaactcagaaggggatgctccttaagcacaactatcacactctgggagactaagtgctctctaagtagaattagaccaccacaggtcagtgtgggatgcagaagcagatcagcctaaagtgcaggccagtaccagaggaacaggacctttcaggactaagcaggaggactctgaaacactccagactatgctgttaacctatgcccaatgtgcagtgattggaagttaacaccaaatctatagttgacacctgtacctagttcttcaacaaatagtattatttatttcagaactatgccaaagaaagtacattttcagacactattaagatttagtgtagcggttaagagcgtgactctggagcagactatggagcagactgccaggaccaaccacttactgtttgtgtaactttggcaagttttcctttgttcaaaatatgtttatttttctcatcttaaggctggaataacagtgtgtcttacggcataaagactgaatgggacaatatatgccctccaatagtactttgtccatggtgaacatttaaacaatagctgttattaacataacctgaattactaaggacctcacatttttactcattattctagagctcactcatcgcaaaaacaaatgtatttcttttataattactttagtaatgtgccttttttgttcccaaaaggtacaactttaataactcaatttatttaaaatttttatttaaatggaattaagtagtaattttcttgacatcaccttacacttttgaacatttttaacttccaaatagcttttagatcttcataacatttctataagcatcataggacagatatctcatttaataaattaggaaacggggtaatatagatttagcgatttgctcatagtagagttaaggcttataagctcttaatctagtatccatataaatcaaccaaacctcaaaaaattattgggcaactgttatgcacccagcattgtggtaggtgcttcggaggatagaaatgttataaaatactatccaaaaccaaaataaatttactttctatttggggagataagattttatattgtcttttgcatagtcttggcagttttgcccagccttcaaagctctctcagatctgtccaagtcaccattctttattattaatgttcaataaaaattcatgtttctagcttatcattattcctactatggcatgagtcaagaaattttctgaggttttaaaaaacaattcctcaaattacttgaatgtactttgaaggttgaagtctcttaggacttaaagagaggatgaaatgtgactcatgctattccctttcttcttttggagaccaataggaggaaggtgtagaaaaaacagcccttagtttgctctggaatggaggatagttaggtgtgagttcaccacagatgtaagaggcaaaataaatatgaggttccagttcaccacatctcttcataccagtctattcttgcttcctggaaaccaagactctttacctacatctcatcctcagctcctgtgatttacgcccccggaattccaaactactaattgtctccaaatacatcctcttgcttcctgtctttaggtttctgcatgtttgtatttcctgattggaatgccccttagaaaagtaattttcttaaatattttaaggagcttaccatatcaagaatgtaatcaaaacaatttaaaaataaacagaaaatataaaatgtatcaccatccccagataaacttataaaacaatttattacagagggcaaaaggcaaacaacaaaaaaagacaaatagtggagtatgttaccagtagtaattcttgtaagaaaacttactggaacagtgtggaatgcaactggtaacaataataatgatgatttaccagatattctatattaattaggcactgtgctaagtacttcacatttattatctcatttaatactctgtcccagaaatgcagtcagtaacattatgcacatttttgagatgaggaaactgattattagataggtaaagtcacacagtaagcggctaaaatgaaattatataacccagtatctggctccagagtataaccatttaccaactttataactgtggcctcacatgtctaaaaacaaatatttagtgtatgaagaataaacagtgggcacttgtaattttaacacaaggcattaatataattttggaggtattataatgatgcattgtagataagtcattactggaattcaggaatggaaacaataacatgttcaaatgaaactagtctaatagaggccatgaaaggtaacatttttgcatcagtaacatatgtctcaatatgaaaattcatacttaaaggttgaaagtcatacacacacacacacacacacacacacacacacagagacagagagagaaaatcattccttatagcttattagtatactcctttatctagtctccctggcatatgataactgataaataaatgaaaataggcaaaaagaataaaggctaaaacaaaaagaaccaaaatgatgagattaatatactacaggcagcattcctaatgtagaacaaagactcttcatctattggggcatctgctgtcagcttaattcctctaaaagcagaatatctcataatttatgccttactttgatgaacagaatacagtataagactgatgaagcaatgagggcaaacaatattgtgtgggtttatttctgaccaagaagaaaggaattgtgaagtaaaagtgccaggaaatttgatacaatgtggtaatctgtgaaagaatataaaaagaaagccagattcaaaaatgaataaaagaaattgaaatgtatcattaggggataaatagaagtttcagtatttaattacaaaatttcgtctggatgagatacaactgcatttcaacagcaattcatgtggaaaagatgagagattattactttcttagaagggtggtgtaaagtgacaaggtaacatggctaacaaaaacaaaaacaacaaaatctaactcaagtgaatcttgaatctagagaaaaaattggtccaaaataattggaattaaaatgacaatctcaagtatgctctaatcagagaaagtatttatgagagcccttcagaatggttttattaagaagagttgaatgagctggaaaagtttgatctgagtgtctactttgtaccaaacatgtttaagtaggtcaccacataaaaggagagacatgcatgcatataagtagctaccctaaaatatgatagtactttgtaagacgcatgagtcaagaagatgcattatttattactatactctatgccttatatctctgggaaccaaaaaagaaagcaatctgttctgcctagggttaggaaggcttcattatcactaccttcaaaaagctgaaacagtctttctgaagcttaagaactcctggacttcagacactatgcccatgaaccaagtggttgcattctaattagacaaacaaaacattaaagttcagcacaggtggcaaaagcttcatttaccaggacttctccctctgacatgaaatgtgctctaacgttattctgttctatttcattggccgggtgcagtagctcacacctgtaatcccagcactttgggaggctgaggtgggcggatcactatttcattaaaattaaaaaaaaaaactggcctattaaagggatttctcaagtctaactaaactatgactcacaatttgagaagcaccacattaaattatctctaaagtttctattaccttaacatttaaaatttcaattaatgcaatgttccaagatataaaataccacaaagtagaaagaaacagaactacctctagtgcttcagtggatagttgctttataaaaaggttagtgtttcttttagccttgatcaatataaaaaaacaataagagtaagaatcatgtcaaatttttacagaaaatgtatatcttatggatggtctttgtaaaatagtctttttcctttttaatataacagatagcatatggtagccattagtcctcatcaaatgctaaatgtaggtctaaagattcaagacaaaggaagctagactaggctattactaaatttattttaacagaagttcagaaacaattttataaagacaacaatttttcaaaaaattagccttcatctgattccttaggaaaactcaaataaacaaagtctgaactgacataatatccaaattaaaatttctgtaaaaaagtccacaatatttgataaaaacagtctattttttttttgtcctgaatctatttccatagacatggaaatgtgacaggatctatctactattacatctctgcactatatttctttcccttctctcatcaaacaaatctgaattaactaagcagctctaatgctagggtcagggcagctgcttccagctccaatattagccccctactcctaaaagtggaggctgacctagattattcagagactcattataaatacttgaagcatcttttaagggatatagtcactaaatcaaaagaatgtcacatacctgtggtatcttccatggacaactatcaaaatgcaatggacatgatgatatctaatagaattgtatctctaataaaatgtctttaatgtattcaatcctttaaaatatttagactatacagcctaaaagatgggcaccctgctgtttttgagatttccaaacactaaatgggaagtaaaggtgctttgtcctagactccttgttaattatcttatatatccattagacttttaacttaatatttcaaagtaggttgctatggattaaagttttgtctccacaaaattcatatgctgaagctctaaccttcaatatgactgtatttggggatagggcctgtaaggtggtgataaaggttaaatgaggtcatacaggttggactttattctgatagggctggtgcacttataagaagaagaatagacaccagagttctctctctttccatgtacatgcattgaggacaggccatgtgaggacgcagcaaggaggtggctgtctgcaacccaaggagtgagccctcactagacattgatgctgctggtatcttgatcttggactttccagtttctggactatgagaaaataaattttggttgtttaagccacccagttatggtatagtgttatggcagtccaaacaggctaatgcatagggcagtgtaattttagttgaaggagctacaagaatatttcttgttgttaagttctcttcaatgtacatgagccaatgtgatgcaaaaaacaataaacagaacttgtaaacaagggctctaagttcaactctcggcactcccctcactagctatgtgacctaatgctccctaagctaattttcttatctgaaaagttaacataataacacatttctttccaggttattgtaaggattaaatctgatgatgtttgtctatttgttagatcgttcattcattcatctaacaaatatccattactaaggatgagaaaactcacacgtatactatattaccctttaatttatcagtcatttccgagttaaatcttttgttcctcagtgaaataaaattttacatgatgtcaaaaaaatctatatggaaaatatataataataaatacaggcaatataatgcatgtattgtaaatgttcctcaatttacaatgaggttagttcctgataaactcattgtgagttgaaaatattgtacatcaaaacttacttaatacacctaactaccaaactttatagcttaccctagtctactttaaacatgctcaggaaatgtagattagcctacagttgggcaaaatcatctaaaggaaagcatgatttataataaactgttggataactcaggtaatttcctgaatacagtacactgtacggtaaatattggttgtttatccttgtaatcacgtggttgactgggagctgcagcttgctgcccctgcccagcatgagagtatattgtaccacaaattgctagcctgggaaaagatcaaaattcaaaatttagagcatggtttctagtgaatggctattgcttttgtattatcataaagtaaaaaaaaaaaaaaatcttaagtcaaaacatcattaagctgaggatcatctgtatgtgtgtatatgtatatatgtatatgtattcataccttcccacacctatagaatcttacctctttgctttcttccagatccgattcactactaaagtcttccgtgtttaaattttcaaagtcagattctcctacagcaattggtacagtcacagtaagactggggttgtttatgaatgacatgtaatcactttcatcaataatgtatttttcaacactgctgccagttcctataccacttgtagttccatttacatctttaagatagtcaagatctttcccaatttctgctgtatgattggacatacaactgtctttcttgttgtttagatcatcaagtggtttaatttcatctaaaatcttttgtttcctaatgaaggactgttgaataaattcatatatttttcttttcacataagctactcctttgtgcatcctatccacagcaatttggagattattcatttcattatcatcatcagtggctgcaaggttgtctgcactaaatgagctcagaagcaaggccagaaagagattcaggaccttaaaaacaacaaaaacatgattataattttacaccaatgtagggaagagcagattacaatcacttattctttcttttaagtgtggaaaaaactctaagttctaaaacttgatgagaaggaaacaccacagcatagtgattagaagatgggtgatctgaatttgtgactggctcaatagcacatccttggacaaagacatgatttctgttgctctcaagttctcccattcgtaaagtgaaattgaatgagctaatctaaggttttgttaactctaaaattgtatgagtagaagaaaacagatttatatgtgtacaatacgagaattcttaaaaatcactaatgtttccaagtatgcatttaaatgcattctataatttttcaataaacaaagatattaaattggatgtcaattgaaaaataaccattacaactcagaatgaagattaggagcttaacataggctgacacttgttttcttaatctattatatttctcatacttcattgttgactaagtagagctgtttatgaataatctctcatatttccatgagactggcacatgaatgtacatacctttagaatattttatgtattactatactataaacagtaacactccaaatttaagagagataaagattgatcagttactccattatggtaatctcaggcatcattagccattcgagaactgatgaactcaggttggctagtgcatctgccatatgacatagagtgattgaatatcatatgctgcaatggggcaaagaaatggcacaagcattatgaactcttaaagacaccactttttagtcctagtctggatggtaattttgcactttctctctactttttttagacttctctcttccttggctctgaatttataaaatggtcccagcacatccttttaggctcatctcaatatgatactctattgtaattcacataaaaaatgtgataaagtgactgacaaaatagaatttggtataaaaaatgcaggggcactgctatattgctgtgttgttaaagtgataatatatccaaggtaatggacttttaaaccaataatcatagtttgtttttctttttgacaaaacagtcaccattaaattatactctttttttttattatactttaagttttagggtacatgtgcacaatgtgcaggttagttacatatgtatacatgtgccatgctggtgtatttccaaaatgcatatcttaagtgggtacataccactaggtttccaatcaccatgaccatcatgaagacagtaaggcacatggcttgaccagcaacctccatacagtcccacatggtctctatccactccccacacagcacgcggaacacaatcaggaaggagtggaagaagtcattcatgtgccagcgtgggagttgacaatcactggcgatcttgcagacacaatctttgtagcttttaccaaagagctgcatgccgaccacggcaaaaatgaagacgatgatggccaagacgagggttaaatttcccagagcccccacggaattgccgatgatctttattagcatatttaacgttggccaagattttgccaacttgaaaactcgcagctggaaaatgaaagattaatatatatttgtatgattcttaaaagcattatatatattgagctttacctagaaatggtcattagaattcaatatcttacaatatctgatctgccctaaccgtctcaggctcatggctaatttttggactccctaggaaaagctggattttccatattttaaccatgtagatcattttctctgatggtgaattatttttctttccttttctttttttttttcttttgtcacccaggcgggagtgcagaggagtgatctcggctcactgcaacctctgcctcccaggttaaagtgatcctcctgccccagcctcccaagtagctgggactacaggcacgtgccaccacacctggttaaatatatatatagtagagacggagtttcaccatgttggccaggctggtcacgaactcctgacctcaagtgatccaactgcctcagtctcccaaagtgctaggattacaggcatgagccaccaagccaggcctcttatagtgaatttttaatgagtacttggaatccaactgttcttaatttgttttataaaggtggttctaaggccggatattataatattaacatctgaatctgaaatatctctgctgaaagatattaatttgccagtagtgtgcaaagtaacatcatactgagccctgatataagtaaagtgttcattattcattaatgctccttaggggtattcatgtagttacatccacctgcattgaaaaacttggaatatttcctataattctacaattattttcctgacttgtaaggatatatgtgtgaattaatgggcatgcttagtaatcctacagactttctctcctttgactttcgcaagatgcatattttccagagacagaattagaaaaagtttctgcatgcacatcttacatctgattttcatccactgctacaaagggctatatatattttcaagttactattaaaaggtgatgcattttcattaaaaatattttcttaggtctagaaatattaactgtagtagtctctagaagcaatacttagtgaaaatagcaactgagtaatacgttaacttttacgtaactatgttctttgaaataaaggttttcataaataattgagaatttttttccatgtaggaaaagtttttgacaatgcaaatgttacagaaaaacttacaatgctaatggttgtgtggcaaaaaaactatgacattgctatgcaagaaccctgattgttagaaaggtttttgaatttggtgctttttttttttttttttaccaatcgaaatgaacggagaacagataatccttccacattggcgagtccaagttctaccaggctaagcgtcacaataaaaccgtcaaagatattccagccttcttggaaataatagtaaggatccatggcaataattttcagaaacatttctgctgtaaagatcccagtgaaaacctaagatcaaaacaaaattaatctaattccaccagataataacatacatgacataagatttgctcttagaacataatgcttatgctattttcccacaatgattctattactaacttaaatttgtatggcaatttgtagttgatgaaagactttcatatacattatttaattttatccttgtggaaacgcgaagtagataatatacaattattactttacagataaggaaactgaggtcttcagatgggtgaaatggcttgcttgatatcatacagcaagaaaatggcaaaactaggatttgagtacaagtcatcttttttttttttttttttttttttttttttttgagacggagtgtcagtctgtcgcccaggctggagtgtagtggtgccatcttggctcactgcaagctcctgggttcacgccattctcctgcctcagcctcccgagtagctgggactacaggcgcccgccaccacgcccgcctaattttttgtatttttagtagagacggggtttcaccatgttaggcaggatggtctcgatctcctgacctcgtgatccgtccgcctcggcctcccaaagtgctgggattacaggcgtgagccactgcgcccagcccaagtcatctatttttaacagtgctctttccattataccaaactacctttttgtccagactttatataccacaagtactgacaacattttgcccatgagcacttttatttatctataagcttattcctatttccctcaatcagagttatacattcttatctattatactaggtgcattactattgtcattctttgttatgcacatgaaaaaaataaatttacttctgtagtataaatagtagaacttcaaaaatataactaataaaatgcaggttgttatgcatgatgcttttgttttctaccatcaaaaatcctaaacttcaaaccaaatattacaggaaatgcataaattactttagatagctctttccttcagcaaataaaagctagtattcctaagttgagttgactggcaaacactttaataatttatgtttttgaagcacaaaaaggaaaaattaagtggcaatcttcaccaaaaatgacctttgtaatcatataacacacaaaatgtactggaagttttcaatagttcatggttttgatatagaatagatggataaacaatacatgtactacttagatcctggaagaggaaaagctggagacatttttgagttgttaaattatttcttgcagtgatgatgactaagaaggataaaagagatccacaattttattttaatcttctacagtaagggaaattgtaataatatctcaaaaagtatgttcttaatctatgagctacttctggatcctgaaaaattataaatattgctgttgacttttcaagtagtgctgtaggcctatgcctttctcagtttttgtgagcacattaagggtgattatttttggcaaaaaagtagagtatagccagctaaatataattgcgattttgcaggggccaggaagcatgaaggatggttgaaagactgctatacacaattaaatgtaaacagtttttcaagcagaaaatttgaagactaaacacatttaccttccaatatgcttaccaagtttcctactgtaagcacattattgaaatggtccgtcattggatagtgctccatggccatgaaaagagtatttaagacaatacagatggtgatggccaggtcaacaaatgggtccatcacaaccaggttgacaacatgtttcacttttaaccaatatggagaacagtcccagattaagaatatgttggaaaatttataccaacagggtgggcatttctgcctggattcttcaagttctagattaagaaaaaaaaaaaaaagaaccaccaaaaggtatactttatacacacacatttatttcatatccactaaacttattttcagtaatcaacacatttttgttacagagacaaccttttttgtacttgttaaaaaaattacagtttactctaaacctcccaaggatatttcatcagacacacacatagagcccaggtaacaatgggtagttttttgtcttatgcactgacattgtggctcagcacttggcctcaagttaaatgagtggtctttcatgtgacgtctcaatgggaacatggtttagggtggtgtagatattgtgtgtgcaaccctatgtgaatgactctacattgtcaacctcagactatgagagctagaatagggattgatgtgacccaagaatcatctttttagcttgtttttattttgtgaaaatgacctgctcttcctctacaatcttgagagtacttaggatgaggctgaaaagggctgtactgctgaagtcttaaactaatggaacaaaaagagggtcactatgactaatgagattagaaacccctaacagaaatgctttgttctgcattttcaaagagttgctacacagttaggaaaacattcttagtcccaatatcactcattttaaaataaattgttaaggcttctagaatatctgagtagatataagaaataacagctcttgaattagactgtcttttcattagaatgcactattcccaactcacaaatatatttgtttgaaatgagacaatataagtttggtgaaaataattgaaacgaaaatagaatttgttaccaaccttctactgtatttgttagaatgctggctatactcattgctcgttgcctttgggaaggatcttctagaaagtccatggaaacgtggaaagaacttgaccttctctttctcatttcagtttcagtggttgttccctgtaaaaaaaaatgctaatgcattaaacaattaatttgagcaatatgacaagcaaacaaccaaatggtgacacagtgaatttcatgaaacacatgcatcatgcactttcatattcaattggtgatggcagatatttctgacttattgtatcattagcctggaatgttcaaactgttaaccatttagtcatacagcaaaaaccaagatgttaacttcctgatttcataattttataaaatacaaaataattttaatatagttgataaaactcttaagagatatatttaacagttattacccttatttctgaactaatagtaaaagcctagtaacttaaaagtcctacaagtgatcaaggcacttgatttttgagaaggtagctatttaattttaaggaagtataaatgattgcaacacacttagctgccatcttattttctggacacaagatgtagatggtcattgacaacacaaactctatgttaaaaagaacacacacatgctgcatggacaacagtttcatccagggtaccaaagcaataagtcatctaattctgacttagtcatgcctcctcatgctgatatatttccaagtgagtaaacagtctaagaagaggcagcatctgtttagaaattcctcatctgagtatacatccacaaacacataacatacctttgtacacagacaattattttatctgtctgtattaataatgtatttgtgtctcttcatttaattttgagaagacctatatcagcattttttagtaagaaaaatatgagtactaggagtattaaggtaacaatgaagctatctacttaagcagtgtttttgaaaatctaaactaaagcagagatcttgaagaatccattggaaagatttattacatacccttgacacttaaacatagaatcattcatttactttcataccagagccttggagaatgtcctgctatctaaattcagtgtgggtatatagcaaatcctccaactggaggcagtaattattgtgtctaatcaatccttagcacttttaataagtaaatgcattcaggtttgtgcaggagactgctaaggttttaagttttagttggttagtctattaaagatattacaagatgcaggtgcattcacagcgtgaccaaccaggaatcattctcaaggttgccgttctgtagaaacactggctggtgcagcaatagtgagccagccatgcctgaactatttaaaacttccttacattgtcatcagtagctggcttatctattatcacctctggcagaagctgtccaacaggcgatgtaggaactgaaggtccaccaaccaaggaaaccacaccattgcaatccacagtgctgtgcatcttcccattcgctggaaacactgccagcatccgggatgacctactggtctgactcaggttgctgttgcgtctctctccgtgtcgtcggggcacaaacaaggaatctctacggctctcgttatcctcaaaggtgctgtgctcatcatctgcgaagtcgttctcagatcccacatcctttgctcgccctctaaagctgaaaaggcttgttctgctatttcgccttggtgaaaatagggagccacggatgctcaacaaagactagaagtttgaaagagcaaacaaataaagtcatattaatatggacatttgaatgtgatttcattttgcaagattatgtagaaggagatttcagcattcataacagaatatggttcattccttttgattatcattctcattttatgtgcattcacattaaattaaattaccttgataaaagaaagtttctagcccttgggattaaagaatgaggagatagattgcaaccttaacatattgaaacacacacacacacacatacacacacaccctgaacgaccatttctcaagttcaaagggaaacatccttagaatatggcaatggacgtggtaaacattcagtgaacactggcaccatgaccttaacaaggccaccttggtttttatggatcttgtctttcaaaaactttcaacactcctcacaatttactttagtccacctttctaaaatcactttaattattatttctttttcacctataaggcattgtattgttggaacttgaagttcatacttctgaaattcagagtcatgtgccttttgatcaagtgtaccatgactaatattttcagaagcatgcatggtgacttataaagaagttagggggaaaaaaaacataaaatcataaaataacctaaggacattcctgatcgactatccggagttccacatttttttttttcttaaaagtgctgaggatcaaaaagattaaatgtcattagttatagacaaatatcagcagacagtatcagaatgacagtccagttctcctgactgtcaacttggtgttatcttaactacaccgagctgtagacttacatatctgtggagtaaagtttttgcataactatgtgaagaagggatgggtttaaatataacacaacagtggttgattcagttgataaaaattcctgagtccattttctaattctccccctctctcccatgttttaattttcaaccatgcatcagtaaactcagcagtgccatacctggtgtggggaggagtacctcttttcatatgtcaatcggttcccttcaatggagaagcgaaaacctttcctcctgatgctgtcctcagattcagatttttggaattcatcctcatctttctcttccccaccagactgctctttctgttttcttttcttcctccgatttcttctttccttagcactcttggaactcaacttagaggcttcagatgagctgtctgagagcctgcctgctgcactgggctctctggaatgttctgaggcagttgccgttgctgcctgctatattgaagagaaatgattttaacatagcacctgaagagactgtatctttctttgaaagggctgaagtatttgcatggcttttaaaaaatatattgaactgactgaagatcatctcacagagaagattctctgcaagtataagaggagattttttttttctttctacctaatgaaggcttttggagataatttagtttgctccatggtaacatttattatgtctctgttaatgctccacagaccacgtattcaaaaatatccaacatgtatcaacaagaaaataaattcattactttttgggatttgatttactttaaaaattggtatttaattagtgttgttttcttttctccgaaaaagaaactcgagtatggaagaaaagctgatgagtttaaggcaggggaatgggataaggacctgaggtcctttctctagttattgaaattggattgtccaataccctcaaaatattattaatcctatttatggacagttataaaatccctttctcacccatccacaatatccagaagaatggggaagggagaatcaatagtttctgctgagcaagataagacatccagttctccaaaaactgtccccaccatcttcaaatcagtactggttcttaaggggcacatgggcatggaataaaacaatgctttttgattatagcttgtactggtactaagttgacacttttttattattatcattgttcccagggtaacctcgataaattaattactcttgcatataaattaatatttctgaaacaactttcttctttagtaaagacaataagtttgtatgctaaacagaaagatgagagagataggagaggcattttatgatttatcacactgtgaggactaacacttcactataaaaacaagtaatcctttttagatggtcaatctgtgtaagattggtaacattcatatgtctattggatgctgctgtatcagagatcattatattatttgatcacttccttataaaggtaataaagcaaccacgttaaaagccaacatatttttagttaaagaaaaaaggagactatgtttaagaactagaggagcaactcttcatatgataaccaataatttcttgttctaagaaaagatgatttcctcctaatgccagtctactcattgaataaaagtctctcacttgaaaataccccaaaataacattttccctttactttgagaatcttaagatgattaaaatagcatgagagagttctattgtggttattattatacacatctcaaataaaataattaaactaaataaaagtaagtggatcatcaaaatatagaaatcattattaattcctcatacaaccacctgctcttaggtactcactttctcttcaatattacgtaacaatcagaacgataaaaggtcagtgccatgagacagggcagctttacctgagctgcctcctgttgctttttaagctgttcaatcatctgctgaaattcggcctctttctgttctgcttcttccaaggtggcctgattctgttcctcgtaggccatggccaccacagccaggatcaaatttattaggtagaatgagcccaagaaaatgaccaatacaaaaaatatcatgtacgttttcccagcagcacgtaatgtctgcaaacaaaaatatcagaattatttctcaatattatttcactaagtggtggcttcaactttcaatttactcatgtgtctagcaaaactcagatataaatagtaattatgttggtcatagcaccctgtactttttttttattgtttctttaacttcagcttcttccttctcttctagcttatgcattcacactatgatttctatggcagaatttttgtattcaccaagaatgaaacagtcaataaaatgccatggagtcctccattaacgacctgagcctttaggaaagtcaaggaacagaccaaagttatctttctatatctgctttttcattttcattacttcccacctgagggataatatttgagggggtagatagggctgaagggagaatgtgccttctgtttaggacaatctgtgtctgagaagggtagggaacaggttttgagccaagaagaaatgggagagaattgcaatccttggcatcactctgctcagtatgtgttataatcaataggatagaggaactcaagtctcgtttcaagttctgctctttctactatattatcatccggttttaatttcataactcaattggttttcttgtatacttttacttaaatggagagtgtggctctttagttctcaccagttgataaagattttcccagaagtcctgagtcattagtcgaaacaaggacaaaaaagcccaactgaaggtatcaaagcttgtgtagccataattgggatttctaccagctttcacacacatatatccctctggacattggctgcaagtggggtaaaagaaagtattacaagtcgttctgctgcctttttactctgatactatgctatgatattgcctagtcagaaagatttggtatttcaaaataaaagtttgacaaataagtaactaatctatttcccaacttttgactgcatatagtcttattagctacttggtgtcatcattaaaatatggtgcagcatttctaataatattttacaaaataatttttgttgataatttgcattttcaacacctccatttcatttttactactatggagtctccagagtttatagctcaatatacttatctaaaagaacaacattgttattattatatactcctaaaaaagtaggaacaggattactcctctttttgtatgtttgctgttatatacagtaggtgtttaatagatatttttctctttttttatacttttatttgaagttcaggggtacgtacatgtacaggtttgttatataggtaaatgtgtgtcatgagggtttgttgtgtagattatttcatcactgaggtattaagcctagtacccactagttatttttcctgatcctctccctcttcccaccttgcacactctggtaggccctagtgtgtgttgttccctatatgtgtccatgtgttctcatcatttagctcccacttataagtgaggacatgcggtacttagttttctgttcctgcaatagtttgctaaggataatagcctccagttctatccatatccctgcaaaggacatgatctagttattttttatggctgcatagtatcccatgatgtatatgtaccacattttctttatccagcctatcattgatggacatttaggttgattccatgtctttgctattgtgaatagtgctgcaatgaacatacgtgtgcatgtgtctaaaagtattacttcttgttttagaaaacataaatcttacctaatatttacataatctcatactttatcaaaaaccttacatatagcaaattaatgtcaataaaattagttggctgttatcttcagtttctataaaaagagagaaaagatacacatatgtatgtgtacatacaaatatacacagatacacacaaattattgacttaccctgcatcagagctatttccacatagtagtgcatctaaaaaaccctccaggaaataatgatatcctgtttgaaaaaagaaagtcgtatgatgaacatttgcattgttaaaaacactcaaatgagaacaggaaggtcaggttctacttttaagtttattgagtaattttaaatatattattcattcaaaggcacaagtatttgtctcttctccctctaaattctagatattctattagatactttacagtgcaaagtatttcttcattatgaagaaatgacattagattagatacagtgcaaagatactttagacactttacagtgcaaagtatttcttcattatgaatgtaaagttagtgataatgacaggtactaacataatctttcaaaaaggtattagcatttgttcaccattctcacgaaaaaaattcattcagtaaaaatagacaggaatgacaggaatttctttgtttttgcaaaacagccacatatttcaaaataaaagaatagtatattttctggtcctctcgcctatatttttaacactatacattttaataattaagtataacatattctcacattttgcagaatataggcaacttatagtaaaatatgcataaatcatatcaacaactgaaatgaaagcaattttaaaaagtcttaaatactaaagctaaaataatgactataggtgaacactacattatctcaaagattcctgtttcttgcaaactccttggcttcttgcaatgtccagttcttctataactttttccttggtattttcaactttctttctactaaatattgacataattaagaactcccctcactgtgctaccagtaacctgtatatacttgaattattcttaggatgacactactatattgtaattatttatttacaaatattcctcctagaaagtcccaatcattaattatttctatattagtgtttgtttgagaccgggtagcctttctgtaaagtttattgaatgaataagtaaataaaagacaaaaagagaaaaacatggaattaaacaatcaatgttggattttgtaagaagatatattttctagatgctaagttttctgaggaatttattccatacatagttctgtacaggacacagaagcacataaggaaaaatatcatttttatttctaatattctgacttccttgaacctagacaggaaagttgacatagtatttcctaactttcaattaaaattaaacaaagagaaaggactataatagtttctggatgaatttttgatatctcatatttataaatgaagttttgcccattaaattcaatgatctaaccttaatgatcagccttaacctgaggaaaatataatttttcagttataatagttacctttaattttaataaatttaattttctattattttcagaaatgaaccattttatttatatttgcatttggtttaaaataagaaccatagatgtttagagctgaaaatgacctcagatattattttacttcgagtattggaaaaatgcagtccaataaattttccctagagagaataaaccctaaataaccctcatagtcagtattttgaacttagataaaacaaacaaacaacagatttcagggagctggtgattgaagtggacctactggcattcgtatcaccagctactaaggaggctgagatgggaagatgccaccacacccaactcattaaaaaaagtatatatatatatatatatatatatgtgtgtatatattttttttttgtagagaaggggtctcactatgttgcccacactggtctcaaactcctggcctcaagtgatcctccagcctcagcctcccaaagtgctaggattataggtgtgagccactgcacccaactaacattttctattactgtctcctgaagctttattaactgtaattttcttctttttaatgtaatactactttttaaatataagaataagatttacttttaggtatcactttatttccttaaggtaataaaataatctattaaactataacactctgaagccatgcattacctccattattttccccagtgtactatacagtttctgatacattaaagacattgtgtaattaatgtataatgagttacatttgcatagtattgtagaattcgcaaagggcattcacatattttatctcctttcattatatcaatcaccacaggaagaatgtatagcaaccaaggatcctaggaaaattctttctagctgaattcttcagccttccaaatgatgataaaatagaaagtggcatttaggagtcaaaactagagtagttatgaacaaagttgttaaatgtatgtggaagccattgataaggtgattaacaaaattcttcttttagttccagaaatataaataatctattatttaaaatccagggggtagaaataccaaataaaatataattttaaatattgttaaatagtttgattaggtaattttctaaaagatcacgtcttgttatgtaatcatttaaaaatatttttcattcctagatggaaggcacattagcaatgaaaagaccaaatatacatgatagtaattcttttttagagggtgttttatttatttcattagttttaaattttaaattttaatttttgtgggtacatggtaggtgtttctatatatggggtacatgagatgttttgatacaggcctgcaatgtgtgctaatcacatcatgtaaaatgggatatccagcccctcaagtatttatcctttgtgttacaaacaatccaattctactttttaaggaaatgtacataacaataattcttacttgaatcttgaatatatgacttccagtcaaactcaaagacagtttcatttataagtgtaccattataattcacagttatattcttttctatactatgttcctccaaggaagcattggtgggaggccattgtatacatttattcctcaggttgcccatgaacagctgcagcccaattagagcaaatacgctcagacagaacacagtcaggatcattacatctgagagcttcttcacagactggatcagggctcccacaatggttttcaggcctgaaagaaagaagtctattactatgaagacttaacacgtgtgaaataataaaagcttcacacaattttcttgaaaacatagatttcattcataaatccaagaatgtttgcaacgctagtggagaagcaacacttcattgaaggggaagaacttatgaagataaactccagaaatgtaatgatttaaacaatgaaatgaagattcatatcccattatgtcgagatagagtaatggaaggttcatgttcttcatggagcctatattaaggaaagggccttgtctttttcctttttgctactgaaacttgtctcatattttcattagggtcagaggtcagttttataacaaaatacctgaataaatattttaaaattcctatttataagtaggaaagattttgctgtacaaccgaaaatggtctgcagtataattgtgccttaagataataaatcctccatgcagactcacactattctttattgtcttattcccttctcttttgttagcaaaaaacttagaagatttgcattgtatacacatagtcattaatgactctaatgaataagaaattacagattggtacatttaaaagggagcaaattctcgataaaactaacatggtgaaaaaaaaaaaaacccatgatatttgtaagtgcaggtcaccttgacctcaaattacagtatctcacataagacattgttaaactccaaggctgataaagcttatgtctaaacaataagaatcattttctttgaaacacctagtcttatgattcctgattttctgtaaaactgaatgtcaagcagagaaggatgctgaatcacatgatgggtccgtctcattatctaaccttgctctcacctggaatgactgaaatcgtcttcaatgctcggagaactctgaatgttctcaatgccgagacattgcccaggtccacaaactctgtgacgtacctgtaatagggagttcacacacaaacacaaaaacaggacacaaagaaaaagctgtaggtacaaagagcctatcctttactctaatcacttcttacctggaattaccgaaatagttttcaaagctctcaagactctgaaagtgcgaagagctgaaaaattgcctaggtttacaaattctgttacaaacctgtagaattaaatcagaattattcaagattttagcaggatttatattacttgcatgggtcttttataaagaccttcttggtgattttaaatgataaatattataagtggtaaatcaggaattagattccatcattaatctttgttcacataatttaaggccattagctaaatgtaaacttcataaagtagacacccttgttgtcactctggaaagcaatgcaaccaacatcatgtgtaacttgtaaaaagaaagtaaatcttggctatggtttagggttttagttagaaaaaaatatatgaaatcacccaacagaaatttaggcatgaaaaggcagtttgccttactgcttttatatatgagataagattttcctagtgtaacttttaaataaaagttaagcaaattaagaacaatacttgatgagggtccaatgctgcgcctattgttactgccattttgttcttaagaaatagaagtcctgtaggccttcttttgagctgtgaccagagagcctagcaaagaattggctcatcctgatcagataggaaattaagaccagacattcggagtcctgagtgtatcagtgccacctctcctgctcctatccactacatcacaactgttagaggccaaaaaatcagctcctgaaggaaggatgagggtaagtgttgttgggctgcctccttctacactctactttcacttagtctggaatggttttctattatttttctgggtctcttcctgaggaagtttgccactagaaaaaaaagcattggggtgcataaactgtgcatattactgagtggatatgaataggagataaggataaggaagtttatgttcagactaaagagatgaagagagccataaaaggaaagaagaaaagaagaaagaaaaggggtcaggagagaaacagaaagaggcagagagaatgtattcctctacaggtcttagaaatcagtaatttaatatattaaaaacataatatttcaagtatcttctttcttctcttagtttgatttgtcagatcgttttgatgctagtagatacttactttcaattattttaccaaaccaataaaagaagctgtgtgtaatatcagcaaggtcattgcaaatttgtgtagccaatagaactgttttgtggctgtaatttttaaagttattttcacagatgtattacaaatatgcttgtgttttgacattagattgtgtgtgttcatatgtgtgtgtgtttgtgcatgtgtgtgtggaagagtggcatatgtgaaattttctgactgatgctacgtgtgaaaattgtagttttcaactactgcaaagccttcatgctatagtgaaattccacttagacctttgttgtgctaaattgaaatccagagtttgaatgtataaatcacaccaaaatattctacaggtaaagcaaacctattcttaaaagcataagcactgatggaaaaccaaactatgttctctcttaaagtttcaaaaaaggcacttacgcaaatgtaatgacagtgaaatcgagccagttccatggatcccgaaggaaagtaaaatcttctaaacagaatccccttgcaataatttttataagtgattcaaaagtatatattcctgtgaaggtgtatctgaaaacaagcatccaaaaaatttgataaagtaacagtgttttttcatagcataccaatttcttatcactccatcagtggaatagataaatactaaaaaagaaaactaagcagatggattttaatttcatacaaatgaaacgtagccctaaatttaaattcagcttcctaacacaaagagttgtttcgtaaagtgtcttaagagtagtgtgagaaatacaaggtatatgaaatctatttagccattgtctgaaatgtcttggtatttatgtaaatatagtctcctgagaaatatttagtatgtttacatgatggaatagccaatcaataatattgcagaagcatgaaatgattttcttttagggaaaaaaatctcaagtttaatagtgttctaagaatgagaggaaactgacaaattagcacgtgtttttttttttctacaagataatttaacttgcttggaacaaggacttctttaaaatcaaagtaaatacttctagggttataagaagtaaaaatttaatttagaataaaattcttctgataattcagaaacttaggtgtttccaaagtttaaatcttctactcagaaattggggtgtgagagtggcataaaatcacaagaaaactagggcgactgaaaacctgtggggcctcccatattagcttcaatactttagaatttttttgtatataaaatttattattttcttcaagatgtcatgtttcttattggtttcagcctggaagtgtctaggaaaggagacactcttggaaataggttggtgcaaatgttggtggacactcttggaaataggttggtgcaaacattagcttcaattgaaggtaatggcaaaaaccacaattatgtttacaccaacctaatacttctgtagttgctatgggtcagcagctgtatagtaacaggcattacaaataggaagtgtgggcaggtgagcagctatggttagagtagcccaacttcagttatcacaaatctggcctctgtgcttcgaaggtatccccagaacagagagatcatcaatatagttagtaatgcttctggtttctgaaagctctacaaaaagttccacttctgttagtttagtcttcagtctactgaattttcaagttctacaaccctgaaactttggattatttttcaatttgttggtgaccacgcttggaactatattggcctgacatgaagtgaatgtgcctgatggaaatgaaaactttgcgaggttcaatgttgtcttcacatggcatttgtaactaaccctttttgattcttgattcaatgtatttatctggaatttaactggaaccaatgtctaccatattggctcttttctgcaattgctttgaccacatttggtttggctactgtagattttaaagaaaaaggggtaaatgtccaagagtggtggtcttcaggtgaacaccaggtacaggcaaaagagagtgataatcagtataacgccagcaggcctgagggccaatgagcattgtcctcttgctgcgtaattttgtctaggaatgactttaataaaatgctcttcagttttattttaagactacattaagacacagtttcaaaatcccaaatgtatatatgttattaaaaatataagttgaacttactctacattctttgtccaatcaggagggttactcattgtcataaacacacagtttgtcaaaatagtgcacataattagcatgctgaataatgtaggttattgttaaggaacacacaaaagaaaatcaaaatccaagtgttatattacaaaaagctaacattgaaaagcccaaactgcagcttagccaaaattcagggataaatgcattgtgggcaagtcttctaatctccttacatttcaatttcttcatgtgtaaaatgtgggtaataatatcaccttcactgagtatttgtatagattaaatgaggtaatgtatatgaaagcattatatcagtataaggtgttgtttttacaactattattaaatcaatatattcacctcccagagaacttcagtgggaagactatttttgtgctacctggagttgcacagtttttcagcagaaagtattgacttgagctcattcaggtgaataaactagtaaattgttgaggaaggccacttatctgcaatattgtaatttcttaaacacatcttatccaacacagttcaacgcatgaaaacaatttgtagtcaaagtacagcacgatgctaattgttgggttgctctattttgactgagtttatacaagtgcagcaggattcgataacattaaaagtgaatattcttgaaggttgacacttaacatgatgggaatgtaattaaaattcaacatagcaaagtgatgttggccaagagactcaacctctctgtgccattgccttgtatctcttcctacttctctacaatggagctaataatgtactcattttgtaatgtaaccatttctacatgcagattaaatgagttaatgtattggaaatgcttggaacagtcacggtacgtaagtaaatatactctaagtggtagctaaaacaaatgaacagacataacagaattataaaactgaaagggaccctaaaaattagtttatcactatattttaaaaatcagggaaataaggccttactaagctctagaggaatcagataaagggtccaggactagaatataagtttcctacattaagatccaatattctttccactatagtttactgccaaaacaaaaattttccataattgaaaaagaaagttttcatcaaatgaccacatgatggcgctaggaatacaaactgggacaaggaaacttccctaagtataaaaaccctatcatatgatttttatgtttcaaatcttttaattttagtaatagcatatttataccactaaagaaatttcttgctgtcatattaaaattagaatggccgttcaaattttagaatcctttaaaaaaaagtatgagcttatgataattataatggtattttaatatctattattgtcaaagctatcaaacaagatacaatcagaagtgaattgttttcctaaattgattaacaaatgaatttagtcgtggagtcctttttaacaccaatgggaatcatgaaaccaaatcccttaagaccatttggaaatatatgccaacttctctcattaacttccggagtctttactaagcaaacagttttgcatggcagcatcataactcatgacttgaatttgaaattcagccaatattccagtacttccttcacaaaaatcatcaggaaatttcaagaattaactaagtactggccaaagactcctgacattctctgacagaaaatatacttaaaggtttattctaagatacactgaagtgttttatatcataactatggataaacttgagtctggaagtagatttttctgttatcatatcattgctcactgaaaattctacaccatcacaaactttgtataaagatggtagaggtaaacatggttatcttactttagatttgtaggattcaatacatataagtgtttttagaaagataacaaaagtacataaatacatgtttatatataatatataaaatgttaaagagtacatgtttcagtaatgtctatgtgattaatgaactttaagaatgaggctaatatgacaaagatgcaaaatgagagtgatgaaaactatataatatggacatttcccaacttaatttgatatttagctataaagtgcttacagatcatgtacaaatagttaatattaatcacttgaaaaaggatatgaatgtaccaaaatcttaatagctattttcctaagaggattgaagggagttaaaatgtacagggcagaggtggcactgaaccggaagatggccttccctttattcaatactataaaagtctgtaagacaggaacacaacatagaagtatgaaagtataaaccacttaaactctgttatctactttctgttacttgtcataataaattattgtaaagttaaatgagaaaccagcacaatcacaatttctaaagtgccccatgaaaacaaactgtcactggatctcttcttaattagagaggaaatccaatgataccacttaccttttacctaatacttaccctcaattttattgtacataagacaattagccaagagaagtcatttattttctcgatattttaagtgtctgagttaaatgaaagtcttaaatgggtgcacatttcatttcattccaaaaaacttaaggcactacatgctttttatagtcatttcagctttcccaattcaaatatcttgaaaattaatcctgtggaacgcaaaatcattcaacagaactgatactatttttgaaataaagattgtttttaccatctatcctcataaaataaacattatcactctcttcgtaatagaaaataaaaacagccaccatcaaacccactcttgggttagatggatgtaatccaataattgatttctggaggccaagatccctggagagtacccgttgaccaggagtgctaaattctgtactgggatttctgagttagctgacatattgaattctaatcccaattgacttcctatcttatgcagtgctttcttatcacagaggagaagctccaagctcctgaagaatccaggatccatgaatgtgaatgaaattccttccaaaaattagacttatttgagatcaattggcagtgggcagacaaaacattaaagaagcaacatgtaagggtataaaaagggctctgactcaatgttttccaaggtgcttacttatatttagacagagccagggagaaagcctttatctctgtgaagagcatatttggggaaggaaattttaagcttcttgattttaaattcacccattcttcgaaagctttcttttctaagccttaggatgcatatctgcacagatcatgttatgatacagcaagcataaatgttatgtttattttctactaagaatctttgtatagtcttagctcattaacagatttcccctatacttgcaggattttctaaattcaagtaaagcaaacccaccctcccacacccctacctgctaatggagttggtttttgaaaattaagcactttctatctggtatgggtagaagtgtcctaaactggctgtgaaagtatggtcccccaaccagtactggttaagtatagatatggagagtccatgtttagaaatttgtaaggcaatttggccaattaatgttgtgtctgtctattctaataataaaaaagtagggggatgttgttgtgggcctgtttttcatttcagttttctagaaactaatttttacttcattttatagaagaatagagacctcacatcctcaacagagtttgagaagcactgctccaagtctcacctctgcctgcattccctctatcatctttgaaggagtatgagtccagaaaacagatagagctttaccacaaagcgcatttgaaggaagggagaatttcacctgtgcttactagaagaacaatcccctatgccaacaatacttagccctctttttctctgattcattgagggattctgtccctgaatgacattgtgagatcatcgtaaatctgaacagacttgtgcaatgcaaatgcctttgctgtgggggaatatgagcatgtaacgacacagaaaggcccaaagtgagctagctcaggaataaatatggtccacctttcaaatgtactgcatatacttcctttccccccagatatgctgagtaaaatctgaaagaaatattaggggctcagatggccagtcgcagtggctcacgtctgtaatcccagcactttgggaggccaaagtgggcacatcacctgaggtcagaagtttgagaccagcctggccaacatggtgaaaccccatctctactaaaaacacacaaaaaaattagctgggcctggtggtgggtccctgtaatcccagttgcttgggaggctgaggcaggagaacaggagaatcgcttgaacccaggaggcggaggttgcagtgagccaagatcgcgccactgcactccagcctgggtgatgagagcaaaactccatctgaaaaaaagaaaaagaaatattaggggcacaggtaggagaaccagtaaaaatataacacagaatatatatattttaaaataagaatctcttgatttcagataatattaaaagctaattttgaaacaaatagtagtgatacaaagagataatgagaaagaaatgacaatccatagatggcctaaatcatgggctggagtgtgaggataatcaagatggtactgtttgtacctccgtggataaggaaaataaccaggctcatcctaaggagacaggaccatacttagaagagaacacctgtgatgctggctccttggccactgttcagcccaaaccatgaccagaggtaataaatgaccaaaacagaaaagacagacaaggagtggtaaagtaaaaggcaaagctagagatctaaaagaagggaggggaaatatttctgccctgagtactaaaaagtaaaagaggcaagattcagaaaccaaacacaaaaggttccaaaaaggaagtctgcctagaagtaaaaagagcagaggattctagacaaaaatcggggaaaggtggggacagagagaaatctgttaaaggacacaaaattacaactagataggaggaacacattctagctctccacaccactgtaggatgactacagttaaaaataatttattatatagtttcaaatagctggaaggaagatattgaatgttcccaacacaaaaaatgataaatgtttgagatgacggatatgctaattattctgatctgatcactatacatcatatgtattaaaaccactatatgcttcataaatatgtacaattattacgtgtcaatttaaaaaataagataaaaggaggtataaagggctgaaactaagtaagatgagtttaatgaaaccaaagcactctcaatgttggtatgtgattctaaatctaaaagtcctttgacatagagaaaattaatactttgacacaaaagttaaaaacaaatgggcataattatcaattgttcaagccttagatgaaaacatttactgattttacagtgtattccctttattcattttaaaaatttaaagaatgtgtagaagattatttggtaacaagatttatatgtgcaatggaaaatacttgcaagttgaatttataaatggaattggtaaggtttttactgaacaacggtatttgttttgctttaatttttcataagacatactgttgtgcaagacatccttgctacccaggaagctaacaataaggccaacattaaaggaccattttttcataggatttcttctgtgagaactccatttttctcagattgaaacatacatgcttatgtacaaacttcatagatgtagctttaaggtattgatggattttaaacagccttccaataaagcaacagtacccagacttgtatagcaacccaatatgtataattttaaatatgatagcactttcatgtcagagtaagttccatttagaatgtcagtcttattatatgtaattgatcttatgtttgtttatttcctcaactgtctgtatcttacctccttgtaattgcttacatagccaagaagccgatcattcagtttataagtgttaagaattaataaaaggatacttgtttccaaggactctcagatacagctttctcccaaaagtggcattgatgatattgaagggagggaagagtctgaaggaaatactgtttgcttacaacaaatacttaagtagctctagagttttcaaatatataaatatttgccttccccgctatacgtataagaaagggctccaagagggaagagttcaaagactagctaagatattgctgtaccttaaactgtataaacaaatattgtgtagctttaagctaatcaagatttatgaactattaaattgggtgactttttaaaaactttttaaaagaatgtattggttagcttattatagtgaagtatcttagcatcctttaaatctaattagttcaacaaagatttcattaatacaacttatcaggataacttttattgcattaagtcatttgaataaaaaagaaacagttcaaagttggtggtggaggagaaaaggtttatacagtagtatctagcccaaaacaaacccctttttaccacccaaggctcataggaacattgacatgactggctccacttacaagcagcaagactttgtggtttagtacaattcaggcacatctatgactattcttaatatttgtccttcagttcattttagtgccaaaacaaatgctttaattgcagttctacaaagaaatagaactgtttgaaattaataacatcattttaacacgtggataattttctgcttcaaaacaaatgttgaagcatggcattgtaactgaggtaacaactagattttatatatgaaaaatcactttacagacttatttgcaggaatgtaacattcatacaatagggttgttctagcttgtcacttatgtcttcatatacaggtaccaagtttattgggcatatatacaataagttggtaattatgtatgagcagggacctagtttaggtccaattgttaatttcaattgatggcaattcagaatacatgtattaactgtttagtacaatatttgcaatgccctgtgctacattctaaagagaaaacaaagatacataggttatgacaccaagacatttataaactaggagatgctcaactatttgttttaatagaatatagaagaattgatgaaggttaccttgaccagcactttccaacagaaatataatgtaagctacaaatctgagctacagttatgattttaaatttcctgagagccacattaaaagaaaaacaaagcaggtgaaattaattttaacagtattttctttaacccaacatatctgaattattatcatttgggaatgaaattgatataaaaaatttttgagatatgtatatttttatactaagtcttagatctttgaaatatggagttacacttacatatttcaaatactcaatagctacacaaggctaattaatctctgctatattgggcagcacagacctaaacttaaaccatccattgttcagcaagctcataccttcttcagcaatccttgccatgtaaaaatcatttctggttttaaagaaaaagcaagaaggaagttatatagaaaaattggtaataaccctggtaattaacagtttaataatctgggaagcaacattatgaaaatataagtatgatttgttttatcttatgttaagggtgcaaactctgaaattagatttctgattcaaaagctaactttgctgccttccagcagtgtgatccggaacaggtttcttaactttctgtgactcagttatctcacttgaaaacagaataaatgtacttagctcatagaggtaatgtgattccaatttagctggtcagattttgatacctagtttttatactttaaataagtaatccagatgattctgtcatagcagggctgttaatatgtttgttacctaatggttgtaaaaaatcacaaaccattggccaaattatcaatgattatgttgtacatgtggattgaaatcttgccccttgatctaactgaatagttactaagaaaataattatgttataatgatttggtagaaattgctatttatgaagctatatttgttattatctagtaatcttttcttgtttctgggcttatagaaagtgatttgtttacaattttttcccaggatggacattgaatttaacaagccatggttttccagtttctttttctcatttaaatatagccattaccttaacatttatttcaatctaggggccatattcttcaaagtacatagtttaaacataagctgtaactttgtgtttcatctaaacattattgaaacattgccaaataacaggactgactccaaatttattgcactttcctactcttaaagtaaatctactggcaaaaacaagaaataacacaggaaggtgagctatgatgatgaacaatacacaaaatgtagaatatactactggttggttaaatttatcctttagcttcaaagtttgaaacaggcaatttccaacttgtacatgagctgtgctccagaaatgcatttggaagtcaattgtttggaaatgtgaacatatattctcacagatacacatatatttctagacccacaggtctatcaaactgttaatgaagtacaattctgaatgaatggcactgagaaactttatcactatgtgtaagaaagtgttactctgaaaatggcagagttctgtccttgaaatagcctggaagtcagaccaggaaaattatctggctctagctcctacccagaagtgctattaagtttttcatagctctaagctgctggcttggaaagaggttccagcatgaagggggagaattagagccatgttgcaagaggagagatgcttcaaagttttgggtgtgaagagcagcatagatggtcaggagattccattagtataatacatatctctggggacatttcttatgctgggtcaattccatggtatataatattttttccccaaggactttaaatggtctcacctacttcccttctcatttgtcatagcctgtgagttcaagccaagcttttcttccttttctggctcactgggggatgaaaagttttcttgcaggctttctacctgactctgaagagagtatgccatatttaatattttttcatctcctagtctcattcaattttttccttccaaccagtgataaccagactaaacaacaatctgtgtcacttgcctacccgtgggccaccaagctttaatatatagccttcacttaatgacagatgtggtccttaagccacagattacaaactaaaatgcccacagaggctaagtgacaataggtacctgccagttttaggcatataagtcagtgatgcctgaactcatatttcaagaggaatccttagatgtataattttatgagtgtgtgaaagattttctgatttataaatgccagaaaataattcaaaattataaataattttgttagtttaacaaaacatgtctgtggactccatgcctcacagtcagtttttaaacattgttgccatatgctcacacaaaagagaagaatttgtacctagagaagagtctgtaaaattgcttgttcctatgctttagctgggtggagggttggggccagtggaggagataactctgcagaaggtgcctccctagaaagtgcctaggtaggcttttgtcagccaaggctgcagagccctcaacctcttctccagcagagagaagaaattataacaacaaggaaaaagaataaaatctggagctgaaacatttttcagccctatatcatcagaatgtacataccatgggtctgctacactattatatggtcagttaatttttctttgactggaaagaacacttttgagcccagcttgattacaagcttgctgtgtgagaactatgagcaaactattcccctcaatttctccatctcaatggagaagattatactaataccaatcttaggattattttgaggataaagtgaaataaaacatgtcaatgcccttagtgaattctaaagtgtcaataaaaatataaggattaaaatatttaaaatgcgtctctgtattctaactcttaaatatacacatataagaacatttctgtttctccaaagcatggccaattttagtattggaattttcaggttcagtatctttcttctcaaacttcctatctaagaaaatgaggccatcagcttccttctgtctgacacctaaacacctccaaaaccaattctgactctatccattattctccatctccattgtcaaaatgctagatcaagtataaaactcctaaatttctccatagagaagttgagtgatttttaacaatgtaaagtggaccatgttactgctgtacctaaatacttgttgggaattcattttgctttgaagataaccttcaaactctttaagatgtactgaaagatcccctttatctagccccaggtctacctccccaacctcaccttattctcttcttacctattacaggtcagcttgattatatgtcttattctatgctgttctctttccttggaagattctcctctccctcctcctttttaaccttcagatcccaatttaaatgccatttccttatagaggcacacaatttaaatttcctgaattgatcctctttgaaaataggtgcttatcaccctactggaatttagtgggaaaaaaaatttctaattattttagaagctaatctagatcactgagtgtctaagattttagtttttcctttgtcacctccctgtctctgtctcagaaacagtcccaagatggtgatgttgataaaaatgaataataataataaataaataaggttttacaaaggcaggaaatggccaagtgttgaaatgaccagtaagggttcgggaaatactgccggcctgggagaccagaatcacatcttgcaaaatggcatgagtaggaaacaggaaggacagctataggcttatttagattccatcactgacttctcttttttttttttccactgctgtgattagtgctatgactgcaaatccaaactaacatggcaatgggccatggaaactcactggtctagttttaaaactagtcttaggcaagttatttaaactcagttttattatttttaaataaagacaagagctatcttgaaagaatctgtggattaaaaaagaacagtaattatactgatattatatatagcatgtagagtacatagcttttttttttttttttgcctgcttaggacaccttttctaacagttcctcttctcttccttttggagtaaatctctgccccactgtcttcccatgtggcttggtggagctgacccaccccttggcaacacaggttagtatatgacagagaccatcccataccaaggagaccatcacataccactagccaaagtgagtggttcagaggaggccatgtgacctaattagactcaattctaggacaactgctagagcttttgaaggaaacctgggccttttttctttcttctttcttgttttagcagaagatagtagttacaaggctgtaggatgttagtttagcaccactggtggctatttctgccatcttgtggaagagccagcctgcaaatgaagccagcatgggtgacagcagagctgaccatggaaaaggagtaccctcatgacattgtttgaggtactgggtattttgatattaaaaccagattcactagacacatttcctttatttttccccaaaagttgtttctgttgggttttggaaactttcagttgaaggatctcctatagatatggcagatactctaaaaatgccaagcatcattttattgatcaacatcaccatcttgggactgtttctgagacagagacagggaggtgacaaaggaaaaagaagcacaaggaagaaatagtgcatagggaagagaaagattgggaagtcaactacagggtcctggatgtaagggagagtctgggtgacttttagttttacaggagctgatgataagcaaagaacagctacacactggggactgcccatatgacaattcgtgaaattataagcttttaataatcatcctcttttctgatttcccgttaattacttttgcaagaaaaactccataattccaattaaaaacaaaacaaactctctccacccaatttaacaactaaaaactcctttggcagtgatagaccaaacatgaatttgaaatcacaaattcatatatgacttctcatggagcccaagaaaaagggagtgtgcatcttttcaggacagttgatagcaagagagaataagttacttttaaatgatccataggactttttaaaaatgaatgcatttctgcactccataattaacaaacatccatttttactacagatctaaaatgtctcattctatttccagtaaactgtcacattgttaaaatgatattttcttccatggtaataatgattcgtctgtaattttaacaagaacatgagaaggaagacattttctgtaataaagagtgggtaaagaatttgaatgtagggccaaatggtacaaaatcagcccaagctatgaaaggaaactgtgaaaaaaagtcccgtgagggaaaaaaaggtgtgttcacaagctaaaatgtgccttgctacacagctaaagtaaataaacaaacaaagggaaaccaatctggaatcatgttctaaagaccactgagtcagagctaacatgatatgaaaaatactgtcaccatattatgatagcatttttttcccctgagtttttaacctggaactctgaaggcttaaaacatctgaggatctaaaaaccttctaatgcttctatgcatcaggaatgttcatgatgcatagatgctactatttctttagttactactacaatattactgaacatggattaaactgctttaacaattttagtagaatatttgaacattacataatttgcacatcttaaactgggacaaagaggataaaaatatgtgggcatatgccattggaaaatatactctcagcagtgacattttaataagctcactgacactgcctttgtaaaagattacagagagcttcagtgtggtggttgtgttttttctattcacataaattccttgcatgtacactactgcactttaacataaaatataacataaggaatggattctgcaaatatttttacaattggcttgttttgtctattccatatagttgagaaagaaaccagagtctttgtatactgatgcaaatgacacattaactattgtactagagtccaactttagggaaatcactagtctaactgcatattccatttcactcaggcaaatctaatccacacccccagtatcagcattagtggaaaatctcgtcctaataaacattttccctggtgacatttccactgtttgaccatttagctgtgtcaagagtactgtgtatgtgtaccgcattgttttaatgaagatcacccagccaatctcagataacccagtcactaaagtaaaattagtcatcgaatattgaaagaaatattcattatttttaaaaggttcagattttgctaagcattccaactttagtcagagcaaattaattccatttaaggatatttttcaatactgaaataatccaattagaaaagaaaattaaaggcagaaaaaagtgtacaggcaacttataaaagtcttaagacataaaaatgcagaagaaggaaatttcaaacacataactcaatcatgtgttctaagcacaccatgttagtttttaaggatttcagccctgcaaaaagcttcgtgtgcattgctgttgaatgacttacatttgaagatttgcttgctgtcagttcaatgtaaaagccatgagtataccttaccttggggaaaactctttcctgataacaatatttcccttatcaggttgttctacttgcacactgtgatttgctccaaaatgccaaaatgcttttctttcctcataccatgtgcatttgaagataagaacagaagatgttaagagcaagtttagacgtgagcctaacaaagtttataagggtttcctcgacacaagaatctggctgtcacttcatcagagttggcctttcaccctcagttttaagatgtttcttttgagtattttgaaaatgtttgcacaattttgttttacatctgtctttatatcctttgctatatataattcattataaaccaattatggaccattttgtttagggacatcccctcgagacaatcacttttatcagtctgaaagctctttaattaaagaaaaaaaagattgattggttgttctggtttccagatgaagaatgtctacctttgtcaacatgcattagtttggtctttctcaaaacattcatttattattttacaaataaggacccagcataggagcagagatactaaatttcttccctgtttgattaagggatagatgctgggtggctttaataatttttagatggtgattgctaccaaagaggtgaggacccggtgtctgggggtagcaaaaggcctgttgaggatggagcccactaacatatcccaagagcagcctctgaataaactaaaagtatccaatggctataaatacagtagcatactctatactgtgaatgaatttctgcctggaacacatcagtcttcacttcaataccgaagtcattttaaacgaattaaaatgtttaggcaattggattatctgcatttttacttttcttatacaaataaagtccttgtagtttgtttagtttgggctttggcttttcagatacattaatttccaaagagttgattaaataataaagtgcaacttttctcataacttaaatggcagttatgagattaataatctcttatcaactaagatttgacaatatggtgttcaaaagcaaagttagaggaaaatgaaatacatggaaaatgatccatcccttcctctactgtaaaatgaatagatcagtttttaaaaaggggaaatatgtagtgattcctaaagtaaatcctagtaccactgtcaactgataattttaaatgtaatttagatttgtagatggtgtaacattaaagttgtataatgtttaaaaaaaaaaaaaaaggaaaatactggccgggcgcagtggctcacgcctgtaatcctagcactttgggaggccgaggccggtggatcacgaggtcaggagatcgagtccatcctggctaacatggtgaaaccccgtctctactaaaattacagaaaattagccgggcgtggtggcaggcgcctgtagtcccagctactggggagactgaggcaggagaatggcgtgaacccgagaggtggggcttgcagtgagccgagatggcaccactgcactccagtctgggccacagagcgagactgcgtctcaaaaagaaaaaaaaaaaagggaaaatatgttatacttaaactgactatatcctgaaaagttaaaaaaaaatctgaacctaaggctagtcaaccttttgtgacgctctttcctccgaaactgtagctgtcaatcggaagtgatttataaaactgcctcaaattcacatattacaaatgccaaacttttgcatgcatttggcaaggactaacttcacacagaactgggccagaaacagagtccctaaaagtttagggggtattttaaggtccaggtccaacaaaaaaatttacttaattacaatctttgtgccctacctttccactaagattcacaaatgcattgtgtcaagtgataaagaagaaaatgttacgaatcacctaacgtcatacatttaatttaaaatcaatgcaataatcttaaaaaaaattttatgctttttgttttggtttggtgaaatgacagtcataatgaacggttggatgcttaacataagattcatttcaagcatggatatgaaaaaagcacgcattcaaatattgtttataggttcttcaggttatgacatttttgttaattcttgccaatattagtacattaataccaaaatattaaataacttgtaaaattctagtttatgtaaaaatgttattttacaggtaacaaaatttcttcaggaaattaattgatttgttgtttataacatgacattgaaattgcaaacccttgtggcatcaaatttgtttgcatgaaaaattagtactaatattttgtatagtctttataactcatgattttgagatttccaagtatttccaagtacagaaagtacaaaaaaattgtatagtaaatcgaatctgtggagagaatctgtcaatttgttaaattagctgcctctttctttccttccttccttccttccttccttccctcccaccctctcttctttcttttttttttttttttttttgacacagtcttgctctgtctccaggctggagtgtagtggcgtcatctcggctcactgcaacctcggcctccagggttcaacaagggattcccctgcctcagcctcctgagtgactgggactacatgcgtgtgccaccacgcccagcaaattttttgtattttagcagagaaggggtttcaccatgttggccaggatggtctcaatctcttaacctcgtgatctgcctgcctcggcccctcaaagtgctgggattacaggcttgagccaccgcacctggcctctttttatttgtcatggtgcatttgggacagttgcatatgttatgatataatcaattcatttctcatgtatatgcataaaccacccacaaatgtgtttcatttcttaaacagaaggatacttaagattttgtgctaatttggcatgtgttggtgctacaacagtccaaggaatgcagtaggcaattagcagcaaaatatgcctgataaaaaacactcactttcttattgatatagtaggggtccaggtcctccaggggctctgacaccatctctggaggaatgtctccataaataaatggaaggttctttccagcttccaagtcactatttggctttgggccattttcgtcgtcatcttttttgtctggtttgggattctttgccttttcttctgcaatgcgtctttcaatagccgcaagagattctctggtgaagaagttgaagctgtcaggtcctggtggtacaagcactgtttgctccatcttgtcatcctgcacattttaattaccatttattctgcatatgaaattcctaaaataaaaggaatacagatattttaaagagtggactaagagatgttaatataaataaattcttgtcatgaaacatgagctagaggatttaaagtctgttttctccttaaattgaaaggtgatttctaaagaaaaaattttaacacaaatggtttctgtgttgagtttagttaagcatcacttatttattaattcttgtgctttactgatacaggaactgtgccatgagttttaaaagtggttcaaatatggccttaatcaaagtacattaggctaattaacactatatcactaatgagttattcagtctgtgacacacccagaagatggagactgtgcgtataaaggcaaaggatagctcatttaacaaggatgaggggaaaaggaattgtctctgagaggacataaaatctaaccctctaggtctgacaagtgattcctggccaagatagtcaggatagtttgcagtgaccaaccttaatgaccaatcaaatagttattgctgtcttgactgggctttaacctcttctaagatttgagacaactggaactatgtcctgctcacttcactagccatgcatggttggcttacttgaacacataaagataaagacagtccacggttggacaaatgtcatttatgtgagtaagaaggagaggaaaactaggctgtaaagaaattgctagatggaggtgggggtggaagaagatagctgtaggtgcaggagacagcaggagtctcctgtttcaagaaaaatgatcagaaagaagtcagggtgccataaactcaatagaaactaagtgtttttcttcactgaagcaataatgaaattcttgctgattctatagtcctatagtgctaaccatattatgaaggcctgaggcaaaaccgtcaaccccatacagcagagtcagacctgatctgatgccagacgccaaatcccaaatgtattgttttaaggcatatttaatatgagctcagatttcacagatattactgagccaaaatattccagagcctaagctgccacttggccatgaattttatttggagactgcattaactcattaaggtcagcaagctatggtacagttaattatagctttggtgtatatgaactacaataagaaaattgcaggcataattattttgtgagggacagagacctcaaatttcaaggaggttctcattgttgtgaggtttataaccatatttttcagagtggatgatcaaaagaagggaggactcaagtttaaatttgtacccttagtctactaagtgaagttttcagcggttcttagaacttaacctgcagttatttagtacctgcaagaataggttgtctgtaaatcaatgaaaactgaatgttctgtctacaaactctggttcccctacaaggcatcaggaaaatactaacatttattttttgcaaataaaagtttagggataacaaatatagtaacttttctcaaaagggaaataaaatattctgatgtatatatatagtttttatttttaaatagctttttgatagaaaatatatgtaaatgatataaatgcaaatatctaaaagaaaatgcagtataatatctcctttttaccttgtttccccaggcccagttccccttcctagaggcaactactactacttatctcccatatatatttccaggtattcaataggtatatgctagaacatgagtgtatgtatacatattctattttaaaatacatattcaaatggaatcttattatacaaactgttttacaccagcattttttacttaaaatgtatattagagttcatttatcttaatttttatagatttgactcgtacctattactggctacatgggtttccattgcatgttatgtgccataatttatttaaccaattccctgaatgtgagtatttgggttgtttccaatctttagctaatattgaataaagttgcaagtaatacatttttacacacatactttcaaatatatgtggatatatttataaaattaatttttaaaggtagacttggctttgtacagaatgtttatttatgatagttactgcaaaactactttctatggagtttgtatgaacttattctcctgacagcaatgtaacagagtgcctatttatcctcaccaatataatatgttatcatatttttgatatttccaatctgacagggacaaagatgagagcatattataattttaatttgcatttgtcttactatgagaaaagtggaatatatttttcttatacttaagaattattttttattttctttcctgcaactgcttatttaaaaacagcccattttttccttctatttttttcaatctatagcatcttttaagacaaaatattagccacttgattttttgatgtgtggtcttttaaaaatgtatattttttgactttatggtgctttgtgctacagattttaaaagatttaattaaaaatgttaaaattgttaggtgattatctaattcttctttggcttctggatactgtataatgcttagaaaggcatccagagagatgggcagtaaggggtaggaaaaaggatataaaatatatacatacacacacatgcatctgtatcacctttccctcttgtatttttagtattttggtggtttaatgttataagtttaaatattttatctatttggaatttattttctatatggagtgaggtagagatcaaagaacaactaaataaatgcagagacagtccatgtctttgaataggagtgttcaatatatcaaagacactagttcttcccaacttgaactaaaggtttaatttaatttctgtcaaaatcccagcagttatttgtggatattgataaactgattttgaagtttatttggaaaggcaaaaaacccaaaagagccaacacaatgttgaagaagaacaaagttggaggactgacactaacccaactttaagacttactgtaaagctgcagtaatcaatacagtgtggtactgacaaaagaatagataagtggatcaatggaataggatagtgagtgtggaagaaggcccacataattacagccaactgatctgtaataaagaagcaaggtaataaaatgaagaaaagatagtcttttcaacatgtattgctggaataactagacatccaaatgcaaaaaaaaaaaatgaacctagaccttatgcctttcacaaaaaataattcaaaatggatcacaaatctaaatgtaaaatgcagaactaaaaaactactagaagataatattggagaaaacctagttgactaaatttgttgataactttttagttctctgtttttcttggaactgtctcatcttcatatttgagttctggaatatttctggtgatattctcagtgctatatatttgtttttggttttctaggagtgatggtgaggaggaattgtgccagcttgcttcttcactgccattttggaaccagaactcaggtgatgactttttagatataacaccaaaggcacgatccatgaaaaaaaagaattgacaatctgatatcattaaaatgaaaaattttgctctgtgaaagatactatcaagagaataggaaggcaagccacatactaagaaaaatatttgcaaaagacatgtctgataaaggactgttaccccaaacatgcaaaaaattattaaagctcaacaataagaaaatgaacaatctgaataaaaaatgggccaaagacctgaacagacacttcaccaaagaagacacacagatggcaaataagcatatgagaagaagatgccccacatccatcatatgtcattagtgaaatgcaaattaaaacaataagatagcactacaccctcattagaatggtcgaagtccagaacactaacaacattaaatgctgatgaggatatggagcaatagaagctcacattcattgctggtgggcaagcaaaatggtacagcaacttggaagacagtttagcagtttcttaaaaaccaaacatactcttaccatatgatccagcaattgcataccttaggatttaaccaaaggagttgaaaacttatgtccacacaaaatcctgcacacggatgtatacagcagccttattcataattgcccaaacctggaagcaaccaagatgtccttcagtaggtgaatggataaataacctgtggtacatccagacaatggaatattactcagcattaaaggaaatgagctatcaagccatgaaaagacatggagaaactttaaatacatattactaattgaaagaagcaatctaaaatggacatacagtatgattccaactatatgacattatggaaaagacaaaactacagagacaataaaaagatcagtgattgccagggcagtgaaaatactttgcatgacactgtaatagtggacacatgtcattatacatttgtgcaaacccatagaatgtacaataccaagattgaattataatgtaaactatggactttgggtgattatgatatatcaaattgggttcatcagttgtaactatatacaatacctaaacactgtctctaaaatagctcttgaatcaaagaggactttgattctaatacatataatatagcacatatgttaaaatatacctatatacaatacaggtatatttgaactgcgtttaatttgttaatttagggaaaaaattaatttttttcctaaattaattttcttccattgtattttttctcttctaaatagattatttttacagtaatacatatgtgctactctggtgcgagatattgatagttgggggaggctctgcgtgtgtagagaaaggggaaactctatatttttggcttaattttgctgtgaatctaaaactactgtaaaactagtctatttcaaagagaaaaagtacaatggaagaaatgtttctaaatacaatgtaagcattttttaaaagctttgaataaaccaaaagtaaatataaatggatggaaagttatatcctattattagataggaatgctatatcataaagatattaattttccctaaattaataaattaaatgcagcctttgaaaaataatcacaaaattcatataactagagaaatctatttgagacttcatgtggaaaaataagcaaacaagaataaccagaaaattcttaaaatgaattttggtttcaaagtcctcactgatgcaagaactatttaaaagaaagtgtttaaatttttcaaatgatagattttccttctaagttttaaatttatgtttagttttattaccctatgctctgataatgtagttcgtaccatttctgtttcttggaatttattgtgatttatttttatcctaatagaggttgtttttaaaatgacttttctaagaacattaaaaagaaacttattctttattttaaagcagtagagttcattatgcctcaattatattgatcttatttcttatcttatgtagaccttctatgtctgtacatattttttttctacttgactgttccaagttgggagaggcaaattaatgtctatttaatgtgtttttatttattgtggtttctgtcatttttgttctatgaattccaatgcggtattgtttgatgtgtagataacacttatgatcagatctttggagtgaattgaaccctgtacttccttaaatggcccttgtttatcttactgtagtttcttccctttaaagacaactttgtctcatagcatataatgactttaatttctacttatttgcacttatctagtatgtctttttccatcaattcggtttcatccttttcattttactgttttagcactttccttaatatgtatatgtttagatatcatatataggtatattttaacatatgtgatcattacgacaatcaccgtctttcagagtgccacacttgatgttattgtccatgaagttgtgtgaatggacagaaacagttactaaaagccttcctattctccagaaatactgcatttgagaaaagctctctaaagaaaatctccctggtcactagctatcatttactggagaaataaacaaccaagaaagtagaagacatgaattctacactgacaaatatgatcagttcaaacgtattatatataattataaattagttagatacaggaattatattcatatgtaagcaatataacccatattataatgaaatcatactgatactagaaaaagtatttttttaactctaagtagatcttctattcaaatgctacctaaaaataaattatgttatattaattataagaataaaactcattaaaaatctcataaggttaattatgaaatacctaaaaaactgtcagatgtcattcaatattaatattttttagtaatatgaaaaattgttctaaattacatttgaaatctgtacttattctattaaaatacagaaataaatcatgaattttccatttacacttacaaaggagatttcacctctttattctaaaaatttataacagaagacttaattgtcctaatttatgaaaatacatgtcactagatacggggtagtaacctcatagaatctgcagttttggcttacagctttctcttttcataaaaaccagcatttaaatatttggttacatagaggagaccttgctcctttcaaaagaggtaagacaatgaaactttcctaacaagagaagacttcaaagagagaggccttttcaagatgattatggttatgcatttggacaaaataaaattaagaagagaactaagaaaccatagctaggaagaaaaagtaacaaagtgcatgttagcaaacttcaaatctgaaggaattttaaaaaatattggaaataagtagagtagtgggcaatagaaaactggaagaagaatgattctttggaagacaagaaaaatacattaaaagtggaattcaattagataagcaatcctaaagaagacaggaaaaaaataatccaaaagaacatgaaatggaagtgagagatcatgggggaaaaaaaagattgtaagaaaatgaagtggaaattttgagtggaaagaaatagtaaagtaatagcaataacatgaccaatatcaaataacgtggacaaaagaattataaggaaaaatttgttagaatatacaaataataaataaagatataatatcatctggtaatatctaactgaaagaaaaagagggaggtaaatctgtagcattataattaacagattaccttctcgggagactttacaagatcagaaagttaatactgataatattcagtgtcatttctaagactttactaattcattacttatcataaatgttctagtactagatgaggtttttgcttctgggcattatatatctctgtttcccgtagaagaggacacatgtattacgttctggacttgaggaggcatttatcacagccaaaagatgtttatacttgaggtgactgggagtggtaaaccatatggctttggtgaccctcaaagtgcagatggaggagctttatttaaagtaatcctaacccatgaagccttacagttaaactcccttgggcatctgcttttctccagtcaaacaaatatgtacgatagctcacaatgaagtatttcattttccctgtggcatttcacacagaagtcttaactgtaaaggcaaccttataaatgctttgtacccgaagaaactggccttttataagtaaatcattatgtagtttcttcctttggagggcagctctgtgtgactgcttgggcctctgtggttagatctgtttggttaacgggcttttgggctttcacacaaagctatactctccacaaacttctgtgagataaaaaggtgatatctgtcttagtcctctgaatattttttctttgttcagaacctgagaaagatgaatgaaatttagtgtttcccatccccgagagacacccagcatccacaacttcacactctgatgccattgtgtatttatgcaagaaataccataactaaggtaatgtcttgagattttttggttcaataatgtccttaaattctatgttgtttttaaagcctaaaagaaattccccctcctcactcccccgtctctccctacaacctggtgagacaattctctcattttctcctcccagtttccaatgctattgttatgatctattagaataattgctattatttttttgccttatctgaccctagaagtgatttacagggaaaaaaattactaaccaattgattagtgaactgaatataaagtgcagctcttatggtttattcacagacaagaatatatatagtacttaatgtgatagtattttgttgttgatgtggaacagtgttagtctataatacaggctttcaggcagacaagacctagtttaccttgacctctggacttctgaaaggttgagtaagttattttaagagaattagacaaagataagtaaatcaaaaccaataaatggcaaagatttaaaaaacagagattagtctattcctctcatttaatagaaaacaaactgaatcaaagaaaaatgggcaatttctttgtttagaacttatgtgcttcctactttcaaaataaatatgtcatttgtcccaggttacgcagcttattaatggtgggacttaaatcagaacttttattttctaactcccaaaccagtgtctgccaggtcctaatagttatgaaatattcttttaaagctaaataaaatatatgaaaatataagtagctgtgttaaaatagtatttatctactctaattgatctaggtctctccaaggaatttatattacttggacagacccaaaacaaatacagtaaataaagcattctggcaaaaatggagacttcaaaattttgaaaaatgggagactccaaaatttaaaaagatgattgtaatattcaagtttagaatcatatgatgcaggttttaatcctgctgaactatacctccaccgtcaatttatgttttacttccgttatgttttatgtattgctaaactggattatttctagttactaactgagcagatgactttatataatttatctgtaactccaaagttcaatatagttgtgcaacatttatatatcttcaccaccttataatatataatctgatgtggagaaaaattatatatcttcaattctgtctataaagtagtttaatatccatactgaagagaaaccaaaaagacttctgccaaaatgcttgccatctccttgtaaagagctattactattctggggacataaaccatctgggcacgacaatttgtgaagtgtttcagttcgttttgtagtgttcttgccacctactttacaaaagaatgttactgccaataataataaaaataactaggtaaaatgttattcttactgttgtgatctcacataactattttttagcagccaagaaagaaattggtttttacatagaaatcccaaacctagaaagtattgttttataaatttcttttctagaaataatttgatttggtgtaattataattacaaaaatatttcatttgatttctcaataagccaatttttagtaggttggggttaactaaaacaacatatttcagccatatgtttaaaacttttacatttaaaaataacttcattatctacccttagtttttcatgccttatgcaaactgcagttaaaataaggtcagatatctaacatatgtctgtatctacatttgtatactccaggggtgtttttcaagacaccctaataataaactaagaagtaaaaaattcattcaatctacatacaatacatagaaatacaatacatagtttttgcctgagattcagatctcaggcaaaaaattcattcaatctacatacaatacatagaaatacagtacatagtttttgcctgagattcagatctgccatagtttattaggctctgcctgtagttttctcatgaaacacatcagtatcattaggatgattaatttcatttttttccttacagagaagattgtcattaaagagtaagaccatggatagttcacataataaatcatgtgaaatttaggatctcttctagacgatcatagtcagaataatttaagggaattcctttgaacaaatgtcattagtttatatcaagaatatagtaatgactgtcattgtaagtaaattatttaagttaacctcttttagtaaagttttcctgttagaaaataagtaatcttattgtgtgggtgagtggtcactcgacagagatttgggaggatgtagagagtgaagtctaatcctcgtgactgtgattgtggttgcagattttgagataccaagtgtgaggtgataggcacttaaagcccagtgtgggcctcccagggctgtttagctagcaatgagagaggcactgcctatatccaagttgtatatggcaggttttgcacaaagtggattactcgaagagaaagcctaatggccagtctattcatcttcccctttctcgatgttcatcttttctctcccagctctcctttattctcaattttctttttttttttttttttgctcagcctccatctcacttccgttgctgtcctctccccaccccttcccactctggactgtgcctctcctttgtagacacttcaagtccattctatttcattcaaaaaccatggtctagaagtaacttaatgtaaacccacaaagatggagacagaatgaatgccattcttcttgctgctctctcagacaatgcaggtcatttttgcctatggtgctggtaaagccaggagttatgtagctataagtagcagccagaggaaatagtgcctgagtcagcaattgtctttttattgctgtggggcaataatgggagaaaaaatcaggcttggtacaattccctttgaaggaaaaagatgccaacactagcattttaacacaaaatgctggttgggggttgggaggaaggatgcttacattccttctttggaaatatctactttgataaccattttggtaaaataatgcagtgttttcagtgtgcaaatcctttcaggactcatggttgtatggcagacgcacctgacagcaataatttaagggtaccctgagaatgactctgtggtctaaaaagaatgtgtgtttggaagtctgaggtaagaaatctggctggaagtggccaacctggaaatttgctccttattattaaggatttccaaagcctggtccattcctcagaatgtgggccatacagtggatgaagccctttgtttggattaaatgaatgttgctaggtggagagtgctaagtgaaaatgctatataaactgcatgctttttacaaacattagtggttctcccatccagcccactgccactggaccacccctgtatatgagtcctagataaatcctatgtctcccttgctggcttcaagtctcttctttagtctcttggccatgatgccatccctattggactcaatggtgttccagcacaacaatggtatgattagactctgttcctgggagacatacaataccctcctttggtaggatctatgtggaatgtttagtcattagtgttattaagaaatcatagttatttaatttatgttttaagactttcacctttcattctctgaatgttagttagctcagggtgtgaaatggttcaacagaaatacttgagctgctgcagccagaaggatgtttatggtgttatgcaggaaatatcctgcagaattctgtgtggaattctgctcagaggggtttctctttagcataaactcaatttaaaaatactcttctgctcaaaagcattcttatgaaaccacctcaacacaaagcaaaactgtccaggcatagttgctgtatggagagatacagcatagaacccacgggcagcggggctgaagcagagaaaaactgcaggggaaagagaaacagatccaggaacggggagaggagagtgttgagcacaaattaactaccctggggaatgagtatcaggtgtttgacactttcacttttccaaataacctgaagacaaatggaacctccctgagttatgaaaaattgagactagaagtatcagagctgcagaattcatttggttcagattctgtatatataaaatctagacatagaacaagtctaagcaaaggcatattatctgcaatggttactatggattattgttcagagaagaaccattttggtatagagaaagctgaaagaacttacagaaaataggtcttgaaagatgaaaggcagagataatttcctgattcagaaactcagtatattaaattttctgtatgttatttatcatttatgatataaaattatgcttaatttatcatgtaaactgaaaataaaattctaagccccctgactgaattgaccttctcctggccaaaaggatcccagagtaaccttgaagactgaattctcagccatggtggatcagggagtcagacatacctccttataacccctccctcactaaccactatgaggctttcttccctaagggctaaacagaaatcagccctttcaaaagactcccccactgacatggaccaaccacctgacactttccctccattggtgcctcataagagaccacccactagggaatgattctagccattccactgagaatgtgcagtaaggatttttgtgtcctctgcttcaccttttaatgtcagagggccgaaaactctaccctcggatcatgctaatgtcgccattttttccacatggatcccacaaaggggcatgaagctcagttgaggatgtgcatgcttctcctctcataaatattcatgactcctcctataacttattgaacatatatatttggccaccgtgcttagcataaatttctgtttcctttttccctcccttgaagtgtctgtttctggcttctggctggaagttatgcttcccaacctgtcagaaggtcactctgcaggctgcagccctttataagaaataaagctctcctttccaaatttatgaacctcatcattcttcaggtgataatcatataaacgtctacttaagtttgctttcagtctgtcatgtgaattcagtcattctcactatattccttttgtggtatactggtctgggttaaagagaccctctagggattattatacagtttcgtcttgtttgagagctcagcagctgatgattatcacagatttgtatagagtggacactaccagatgtccagcacatctgtcacagcagatgtgacattgagccaagtctatttctgtctaggtgtatgatacttggtgctatactttggatatggtttgtcgccatcaaatctcatgttgaaatttgattcctaatgttggaggtggggcctaatgggaagtgtttgggtcatgggtggatccctcatgaatggtttttgcctcattctcactgtaacgagtgagtccttgctctgttagttctcatgagaactggttgaaaaaaaaaaaaaaagagcagcctggcacggtggctcacacctgtaatcccaggactttgggaggctgaggtgggtggatcacctgaggttgggagtttgagaccaggctaaccaacgtggagaaaccctgtctctactaaaaacacaaaattagctgggcatggtggtgcatgcctataatcccagctacttgggaggatgaggcaggagaatcgcttgaacctgggaagctgggagggagaggttgcggtgagccaagagcatgccattgcactctagcctgggcaacaagagcaaaactccatctcagaaaaaaagcctggcaccccaccctgtctcttgtttcctctctggccatgtggtctctaccccacacaggctgcccttgccttctgtcatgaggggaagtcacctgaggccctcaatagaagctgattctggtgccatgcttcttgtacagtctgaagaaccataagtcaagtaaacctctttttaaaaaaaaaaattacccagcctcagatattcttttatagcaatactaaatggactaagaaacatggtctatacagtcaattttgttcatttctttaatatttattgaatatagacaatgtgcaaggcactggttagagatgtggagactatgaagttggcaaatagagaataataatattgagaatcctgcaaagtaaccaaattgattttagaagctcctttatgaaatagactttaggctttagtcttcttggatctttacttggaaatttaggtattcctgattttaacagattcatttttttaagtcccagagtagaagaaaatggaggttgaacactgaaacattgactttgaaaactgaacatctctgtcaatcccacaatctgtgtgtttgtgtgtgtgtgtgtgtgtgtgtgtgtgtaagggtatgagctacaacacaatcttgaattgtcactaaaccatttttaaaataattggtcaaccacccatcacatcacttgtattcacaatcccataaagttatcagaccagagtgatttttctctaatctagatgtacattaaaatgtgcatctcatttaaagatagttttggtacatcaaagtgaatgttgataaacatgtaagacaatggaatataaagttcaatgcatgtcctgcattctctccatctaaccatttttgtggtgccaatgcctattttcaggtgtcaatgatgaagaactggaaaaagatatagttaaaacaaaaattgctaaagaaaaaaatgcatgcttttttggattcatttctactctttcatatcaatatgttttctaacatttcttaagtgctgagaaaattttcctttttgttatcctcaatagcaggtggcagctgaaattgttcaattatatgctttgttaaaaccttataaataatttaaatactattattacagtcagctaaagcctatgctcaaattatattttcttttgtttaaattcccaaatatatctcacctgctaccctacattcacccccagtaaagtcccaaagcccgtgggctaggtagggcattattgttttagaatgttaccaagttggcctagaagagtacttgatttgttgcgacaactgttgttgttctctaggtagagtgttgcgtaaaggaaacagtgatgtccaaaggggctggactggcagattggaagtagggagacccaaggtcagcattatgacatggaggatatgagtaaccaccataatgatttaagatatctgaacagggttgccagaaaaaatacatgccacacagttaaatttgaatttcagataactgatttcttaaagcataagcatacctcatacaatttgttttatatttactatactttaagttctgggatacacgtgcagaacttgcaggtttgttacataggtatacacgtgccttggtggtttgctgcacccatcaacctgtcatctacattgagtatttctcctatccctcccctaggcccccacccctcgataggccccagtgtgtgatattcccttccctgtgtccatgtgttctcattgtctatatttggggcccactgctagtaaacattattcattgtttatctgaaagtcaaatataactggacagtttgtatgtttagtttccaaatgtagcagccctatatatgaagaaagtcttctctgctaaaaaaattattttcctgcttcctgaaattcaattaattagcattttcagttcagttagcaagcgcttccttttaaaagacaagtatctctgggagtacatgagtcgtttatgcatcaatgagactacttacttctcaatgtaaaatgcatttctcactgtcaaagtgggttaatcaatcagagagagggcgtaagagttctttttttggttgactaggtaggggatggggctggctgggacctgttaatttcagtggaagaatacatatggatgaattacttttagtggggattttctgatggaatgaattatcaatgtgccaggaagagactatataaaaagatggaatgggggtagagagtgtaaggtggtactgacagaaaaaactcactcattctaggatttttcttgaacaattaaatactcatgagaggaaccagtgttgggttttatttttcaaacatggatgatggtaaatgttaaaaccagtggcaagcatattttcacatttctttcattattaaaagtattgatgtaagattatcctcaaatatatgagtagtgcatctttgcacattaaggactcctcctttattttatcacttcgctttaactccgtaggtcctatacaaaccaaagaaattatcttccttccttccttccttctttccttttttttttttttttttttttttttttgatatagggtattgccctgtcacacaggctggagtgcagtgatgagatcatggctcactgtagcctcaaacttctggccccgagtgatactcacacctcaggctcctgagtagctgggatgcataccagcatgcccagctgatttttaaactttcgtacaggcagtatctctctatgttgcccaggtggtcttgaactcctggcctcaagtgatcctcttgcctcagcctcccaaattgctgggatgacaggcatgagccattgtatccagcaagaaagagaaaagaatttaaacttctaaagatgaaactgctacacgtggacagccataacaacaaagagaagagtactcttaagcatttgtgaaagtcagaaacctataaacttttgggaaacaaaataagtatattttccctttaatcttacaagtgatgcaatacacttctagcaaaagtgaaagggcaaataggaattttgcaacattgagctctctttaagcagaagccaggccataggttcttcactagtcaccagggtctacagcctttattgtctttaccagtcactaggtatgagacattttctcataaaatgtaactactatacattcgccacaaactttaaacccccttttcacctcccatggtacccagaagagtgataggtacttaataggtcctcaaaaattttcagctaatgaataattgttaattaaaacttatactagaagcaaactcttaaaacatattctaagtactaaagtctaatattttatatctattggtttattcatattcttgtttgttaatcctaatcaaatagtgcaaagtttaaatttcattttcctaagatttgttttaaaataacacgatttacccaagtgatttcaaaccacaattacattctgtttaaattactaatattttattgcatcacaatctgcatgaaacagatgtcaggatataatgaactaacctgcattgtatttttatttttgtctcctgtggcataacgatttcataggaaagagaactacacagctgactgactgatggggaaagttacacaatggatagctttgcagcaacatactaatgcggtagggagatgctgcagagaggctagaaataaaatcatttctttccggagcagcactgcttgctgtcggctgagacaaaaaagagatttcctttttttcctttcttttttttgaaaactcacataacattaattctgttaagcactggatacacggaaaggtgtttaccttagaaaatcatttagcaatttttagaaactagacatatagcaattttaaatctttttaactatctaatgaccaaagcagagggtcctcacaagagggatttagatgctactgaattgaataaagaaaatatggatacatttattgtatgccttattcagtttgaggttcattttgagtttagaaatagggatataaaaacatcaggggttaaatagcatgggtaaaggacatgaaccaagctgcagagaagaggctgactgcctgctatatttgcaggcattactcagcacttttcttaaaccgatacatcttgctggctgcataagcaagacaagacccttttccctatggctcaggaaggcagagaagtcaacttcagccttgaaaaaggcaaatactttagtgcaataatgaaatcaactaaacgtcttgtgcttaatgtttctttccccacgccactagaattgtatgcataatcattctatgcaacatattgaagaaaccaaaatgtttgccacagtgtgctcagtaatttttttttgaatgaatgaataactgaattcatgatcaatgccttatcctaggtcacctgctcagtgcacgggctataggaagggcaaatgtcactgtccttcccacccatctcattctaacacaagtgttatcatcaaactaaggaaactaaaacatgtagccataaaacaactgtttagagcttcattcagataatatttttttctttaaaatccaagaatgtaataccaaattttaattaagcgaaggcgtctttgtggagaacttaaataatatggcatattgctttctgtttatctagtagagactacactttgaaaatatagaccattgcattcataaaaatcatgtggagatctttttgaaaacacatagtccaaggtcccacctcaagattttgtttcagagatctaaggtggacctagaatctgtgtttaaactgcttgtccaggtgatcaggatgtagcactcatagttaatgaatgggcaaattttgagaaacactgttttagagaatggtctaggaaaagcatccattacaaatataaaaaagcaagcttttggtacctaagggactgagtcgattcatgcaggtattggtttgttgattaaagatgcatccataattcaattaatttaaatgttagaacaggtcatatcttttgggtttatttttaattgtttcgtacagatgaggtctcgctatgttgcctaggctagtcttgaactcctggcctcaagtgatccttctgcctcagcatcgggagtcactgggattaaaggcatgagccaccatgctcaggtaggaaaaaatcatttcttacatggagatttattttctcaaccaggtaagttttgtgataagatcattaaacttagaataagaatagtcaggttcaaaatttggttgtagtccttaacaaaactgtgatattaaaatagtaccttggccttgcttagcttcaattctatcatttataaaatgggaataatttttataataacacatgataggtgccaactcagccctcactccttttttgaaattgtcctccatgtaacccatactgaaagtataaactatgtttataccatgtgactctttcacccctttcccatggccacagcttggtaggttttatgaggacgctgatcacggggcactcatctataggcttaactgaaacaatagaatttgctttctgggtgatgtttaaatgaagtaagagtgagtgagtcagaatgttatgagaagatgcactgcatgacctagagttgaggatgaggaagctatgtctggccatgaccaagcagaggatatcggccaaagcagaaaaaaaaaacagaaataacagtagccatgcaagcattcagaaagaatgtaggctgtgttgatatgtttctggacttctcattccagtttaatctctttatggcttacttgggttttggcctatgggattttcagttgaattcttctttttttttttcctttgagatggagtctcactctgtcgcccaggctggagtgcagtggcgtgatctgggctcactgcaagctccacctcccaggttcacgccattctcctgcctcaacctcctgagtagctgggactacagttgcctgccaccacgcccagctaatttttttatttttatttttagcagagatggggtttcaccgtgttagctaggatggtctcaacctcctgacctcacgatccacccgcctcggcctcccaaagtgctgggattacaggcgtgagccaccatgcatggcctgaattcttataataaataaaccattttacttatacccgcttaaatgtgcctttatgttttgaatacaagtgttctgacaaaagcacaatgtaaaaacactgaacataacatgttcttaacttttgttttaaaacaaaagaaaaaaatggaggttcagcaaagttaaatagcacaagttaataaagtgatgaccattgtcagacagtttggaggaagtttgagatttaaatccgggtctaatctttcacagttcaatgctcttgttttaaaaccagaaattcaggcagcaagactgatatttcattagaaacacttatgaccccaatatgttttcacattgagaaactgagtcattccactttttcatgaaaatagctaaaagaatccttatcggtcaaatctttcacacacacacacacacaaaaatgatctttaacattatttcaagtacttggacaaataccaagttgggataccagagatctatgttatgaaggatggataaaacatctgataagaaaaaaagaaagccattattattacaccttaaatattaaatgagaaaacaaggaatgacccttggagaacgactaattttgagaattgtatactgatagacgtgttggaatggactacttgcaaacagaatcactgagccacttaatgagttgagtggttgaaagtgtccttttaaatgatcaatttagaccccagagaatatctgccagacagaacaagttttagtgtagttgatagtaagttgtgcccagaatattaaattgagtcaaatttattttccacataaagtcacagttttatatgtcattatataatctcttggcagaaataaggaataacattctgaatgttgcactccaaaattcaaagaatcttagtataaaaatatctagcattttagatgtttcaaagtagggccaaatgcagaaaataagttggatatgataaaaataccagaaagttctattcagttggcatcttactagcagtttcatcttctaataatttagttgctacgcatggagtagaatagaatttaacaacaacaaaagatcattaaataccaatcaaccaaacaaccaaacaccaaaggacctattaaacttcaacgatgctcagttatactcttgagggtacagggctatcagagatgggcagtgtgctcctttcctgtgtagtctatgggatctatctatgtaaccctccatgtgctcctacccttccccttcagctgttaaaaacacaatgccaaaatcaggatcaaacaaaaattgcagttacacttctgaatttggcaacatctatttcaccactccttttagatcatttggtctttattattctgctttatattgtatttgattttgtaagtcagatcaaataatttttggaaatagaaaacaaacaaataagctccccattgctacagtttatacccattttaaatgatttatctttccatagggataaaaattcaattacgtaccctccttgtgacaaacctccatacaattgaaggcagttattatgtctctctttagttttctcttttccaagctgaaaaattttcaatattttaacccataggtatgatataattatttgtattcctcttttgctcccttctaatttctgcccaacttcactaatctccttagggtagaaactgtaatagaataatggtgataagaacagtaaaaagatgatgtctgatttttgtatacatttcccttagtacgaattactgtgtcaagttttttagtaatataatacctttatttagcctttgtcattgtacaagccagtttgacattttaacaaagggggattgaaacaataaaactgatctttaaatataaaaatatcccatgatcccatgattctcctgttcttcctgctatcaatcagaaacaacgatgcctgttaaataaaagagccttattggttctaccaaatttgtgactaattagcttctctgccatcctgttatttgtatagtttgttcttggttcaaaatatactacacgctaaccaaacttgacactagagtctcacttgccttgatgggccaattcctaaaggtttcaaggttattctgtttcctatttatacattcctcagagctattaatatcagtttcacttaaaatttatatttaatgtcaatacccagcatgaaaaactattaaatggtaatagtctttagattaatttagataaatggtaattaatatatttttccaggatgtcataaaatcatcattacttaccttgaaccacttgaaccctcccctaaaagcaatatgatacagatgaataattgcagaaaattaggcccagatttattctaaagttttcaagaattcataatgtcccactccagttttggattcatgttaaatacatgtcttacaaacattcacactatattctttttaaattatacaaatgtaagtatttaataaaatgcaaattctctcaaagagttattgactccacagaagacttttgagagtcaatgtctattgttactatcaactgacactgaaagttcaatttctttcattcatatggtagtccataattctgatatgaaagttggaaatcagggatgaaaaatcacttttttttttggttgttgttacagagtctcgctctgtcgcccaggctggagtgcagtggtgtgaattcggctcactgcaagctccgcctccctggttcaaacaattctctgcttcagcttcccgagtagctgggattacaggcacccaccaccacacccagctaatttttgtatttttagtagagacagggtttcaccatgttggccaggctggtcttgaactcctgacctcgtgatccacccacctcggcctcccaaagtgctgggattacaggcgtgagccactgcgcccagcctgagagatcatgttttttataagaacatatacatgtatagatatgcaaataccttcttaaagcacagataagtggtatccattatttttttcttgatcaacatgacattttgcttcaactcaaaagaaaattacattgatctgacaatttcttttcacaaggtcatagtaattttattctatgctattctaggtgactattaattttaatatatgtgtgactttttgttgtttttgttttgtttttattgaaatttgaagatactgagttaagatgaaagtcctaaagttcttcaatcacttttctgaaatctagacctccaaatttgccctttcataaagtttaccactagacttaacaaaacactctaagtgttcaccattagtgatgtaaatctaaaatactatatacttctttcttctttgtgtgtgttttttttgtttttgtttttgtgtttttggagacggggtcaggctctgttgcccgggctgtagtgcagtggcatgatcgcggctcactgcaacctaactctcccaggttcaagcaattctcctggcttagcctcccaagtagctgggactacaggtgcatgccaccacacctggctaattttttgtattttagtagacacagggttccaccatgtcacccaggctggtcttgaactcgtgagctcaagcaatctgcccgccttggccttccaatgttttcttttttaacaatttacaaatgtacagtgattacacttcgtttctatttttgaaacttttttcaccttccttcctagaaggggaaacctattaatagttctagaaatctcaatgcctacctcatcctttagtctttattaatttgttttttctaaatgccagggtttgaaaatcagataaacaccatctctagagatctgctatatgtttaaaaaaatgcttatacgtgagattatctagacttcactttgaaataagagatataaaattatatttggtatgttcaaaggtacttgtattcaattaaaaaaaaatagggtcttgccctgtcacccaggctggcgtgcagtggcatgatcatagctcactgcagccttgaactactgggctcaagtgatcccttcctcagcctcctcagtagcttggagtacagatgtgtatcacctgaccagctaatttttaaaaatattttgtagggacagggtctcactttgctgcctaggtggatcttgaactactagcttcaagcaatccttccaccttggtctcccaaatttctgggattacaggcatgagctatcacacctagcctctatttgaagttgtattctagagtcttgtagaattagaaaacttttatctagataaatagaggtcattgtagaaatatttgtatgcaatctgccttgtttggatgaagttttcttctcttgcatttgtaacaattcacaagaaatatctatctgtctatcaaaatctggcagagacacaatgaaaaaagaaaactttaagctaacatccctgatgaatatagacacaaaaatcctcaacaaaatactagcaaattgaacccagcagcacatccaaaaagctaatccaccatgatcaagtaggctttattcctaggatgcaaggttggttcaacatatacatatcaatagatgtgattcatcacataaacagaactaaaaacaaaaaaccacatgatcatcttaattaagatgcggaaaaggctttcaataaaattcaacatctcttcatgttaaaaaccctcaacaaattaggccaaagcataagagccatctataaccaactcacagccaacatcatactgaggaggcaaaagatgaaagcattctccctaagaactgaaacgaaacaagggtgctcactcttaccactcctactcaacataatgctggaagtcctagccagagcaaccaggcaggagaaagaaataaaaggcatccaaatacgaagagaggaagtcaaactatctctctttgaaaatgatatgattttatacctagaaaacaaaaccccacagtctcttcccaaaggctcctagatcaaataaacaacttcaggaaagtttcaggatgaaaaattaatgtacaaaaatcagtagcatttccatacaccaataacatccaagctgagagccaagtcaataatgcaatctcattcacgatagccacgaaaagtataaaatacctagtaacacagctaaccagggagatgaaagatctctacaacaagaattatgaaacactgatgaaagaaatcagagatggcacacacaaatagaaaaacattccatgctcatgggtaggaagaattaatattgttaaaatgactatgccacccaaagcaatttacagattcaatgctatttctatcaaactaccaatgtcatttttcacagaattagaaaaactatttgaaaattcatataaaacccaaaaagatcctgactagccaaagcaatcctaaacaaaaagaacaatgtctgaggcatcacaccacccaactataatacaagtctacagtaaccaaaacagcatagtactggcacaaaaacagcttatccaccacaatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatctcaaaataataagagctatctatgacaaacccacagccaatatcatactgaatgggcaaaaactggaagcattccctttgaaaacgggcacaaggcagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtgggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaaggcaatcctaagccaaaagaacaaagctggaggcatcacactacctgacttcaaactatactacaaggctacagtaacccaaacagcatggtactggtaccaaaacagagatatagatcaatggaacagaacagagccctcagaaataacgccacatatctacaaccatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacctcatgtccaaaacaccaaaagcaatggcaacaaaagacaaaattgacaaatgggatctaattaaactaaagagcttctgcacagcaaaagaactaccatcagagtgaacaggcaacctacaaaatgggagaaaattttcacaacctactcatctgacaaagggctaatatccagaatctacaatgaactcaaacaaatttacaagaaaaaaacaaccccatcaaaaagtgggcaaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatgtccaacaatgatagactggattaagaaaatgtggcacatatacactatggaatactatgcagccataaaaaatgatgagttcatgtcctttgtagggacatggatgcaattggaaatcatcattctctgtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctggatgacgagttagtgggtgcagcgcaccagcatggcacatgtatacatatgtaactaacctgcacaatgtgcacatgtaccctaaaacttaaagtataattaaaaaaaaaaaaaaacagacacatagaccaatgaaacagaagagagaacccagaaataaagtcacacacatacgacgttctgatcttgaacacaatcgataatagcaagcaaggcagaaaagactccctgttaaataaactgtgctgggataactggctaaccatacgcagaagattgaaactggaccccttcctttcaccatatacaaaaatcagttcaagatggattaaagacttaaatgtaagacctaaaactctaaaccctagaagaaaactaagaaatacctcgattaaggccttggcaaagatttcatgacaaagtctccaaaagcaattgcaacaaaaccaaaaatagacaagtgggacctaattaaaataaagagcatctgcacaacaaaaacaaaactatcaatagagtaaacagacaaccagcagaatgggagaaaatatttgcaaaccatgcatatgatgaaggtctaatatccagtatctataaggaacttacataaatcaacaagtgaaaaacaaccccatttaaaaatgggcaaagaattaaaaagacagttctcaaaagaatacatacacgtgaccaacaagcatatgaaaaaatgctcaacatcatgaatcattagagaaatgaaaatcaaaaccacaatgagataccatctcacaccagtcagaatgacaatttttaaaaagtcatgggcggggcgcggtgactcgcgcctgcaatcccagcactttgggaggttgaggcgggcggatcacgaggtcaggatatcgagaccatcctgactaacacggtgaaaccccatttctactaaaaatacaaaaaattagccgggtgtggtggtgggcgcctgtagtcccagctactcaggaggctgaggcaggagaatggcgtgaacccaggaggcggagcttggagtgagccgagatcgctccacagcactccattccagcctgggcgacagagtaagattacatctcaaaaaaaaaaaaaagaaaaaaaagaaaaaaaaaaagtcagaaaataacagatgttggcaaggttgtggggaaaagggaacacttatacactggtggtgagaatggatattagttcagccactgtggaaggcagtttgaagatttctcagaataaatgaaaacagaactaccatttgacccagcaatcccaatactgggtatatatccaaaggactataaatcattctaccaaaaagacacatgcacgcatatgttcattgcagcactattcacaatagcaatggcatgcaatcaacctagatgtccattaatggctgactggataaagaaaatgtggtacatatatgctagggaacattacacagccataaataagaacaaaagcatgtcctttgaagcaacatgggtgcttcagagaaaataccattcaacaaagtttcagtaatattcgagctattttgtggataatgcacaacttttgtaccttaaggcattgttcaattctgtttaagaataaattgtttttgagctgcctattagatttcaagcctgactttagatttgggagatatatatatatatatatgacggtttctgttctagaggagcagacagtctgttaggccagacacagttgaatagcaatatattataatattgaggaagtaggctgggcgcggtggctcacgcctgtaatcccagcactttgggaagccaaggagggcggatcacctgaggccaggagctcaagaccagtctggccaacatggcaaaacctggtctttactgaaaacacaaaatttagccgggcatggtggcaggcacctgtggtcccagctactcgggagactgaggcaggagaatcacttgaacccgggaggtggaggttgcagtgagccgagttcgcaccgctgcactccagcctgggtgacaaagcaagactctgtcttaaataaataaataaataaataaataaataaataaataaataaatactgaggaagtataacaataagttatctttgagacacggaggaagcacagaagaggatataatcacttcttttgggatatgaggagggggaaaaatgttaagagaagcttcctaagtaggtgagagctgaaatgggttttgtaaaataaaaggaaattcaccaggaagataaaggtaaaggactgaggacatgtgaggcatgtaaaattaatatgatcttttagtcacttagaaaaaataccataaagaacactaatagtgtttaaaagcatctacccagtgccaagaactgcattatgtattggtgaacataactttagactttaccatacaacgtgaaaatatatattattatcactattttacagatgaagcaataaaagtcagaaaaaatgtagctaattaaagtgatactgtgtatagctagagcagtgtatagctagagctgatttgtctgactctagccctagtttctttccattatatcaatttcctggaaatgtatctctgttcatggcatagtgcctgacactatgcttattaatatcttttgaataaaagaaccactgagtgatttgaaataaaactaaatttagttagttaattttattggtggtatatagagatagtaggaaaaataattgaaaagagacataaacagatttgccaatactttctaagaaaaattatggaactagagtttagtcaaaatgaatgctttcattgttagaattcaactttaatctttgcagaatacaaacaaagacccattttctagaagaagtaacagggaagagagagtaagaaagagataatgatgaacattgtctaatgttacagcataatctagtaaggtaagaacagaagagagttcattgacttaccaacatagttgtccctaatcacctctgtgaacctagagtgctacgatataataatgattgtggtggtttaaaaagtaaatggggctgggcatggtggctcacatctgtaatcccatcactttggaaggctgaggcaggtgtattgcttgagctcacaagctcgacaccagcctgggcaacatggcaaaaccccgtctctacaaaaaatacaaaaattaaccaggcatggtggtgcgtttgtgtagttccagctacttggaaggctgaggtggggggattgcttgagcctgggaagtggaggctgcatgagccaaggtggcaccactgcactccaacctgcgtgacagagccagatcttgtctcaaaaaaataaaaaaattaaggtacattttatatatgagactatgagaccgccaaatgatatttctcagccaacagccttcacagacatttgtcttagagccgatttggctactttgtgttgccagtatgctgttgtaagaaagcacaggaatgcttgtaaagaagaaaagaattggtatcatggtcctgaaaaaagttatttcctcaaggaataaaaatagcaaaagaaatgacgtaatttctcagcttctgatatgtttcaaataacctcagtgaagtcctaggggaaatagcttatatcatatgtcttactccttaggatttttgctatagaggaaaaagtgtgaagttttcttaatttaatgttttatacatatttgcttgctgtacctggaccttacaaagtggatactctttagaaagtgatgaatattttcacttttaaaaggtttcagagtttaaaaaggttaaaaagaatcattcataaaagtttaaaaacaacttcatcaagggtttcccttttgccaagttataagtttaaaatgagagaatgaatttggttattaacagggttaccaccaggcctgaatgtaaattaaacctttgccaatagaagtgaaacagaaagaatcaaccaacaattttatgaattacagacctcatacacattaaaacttctacatatgtagttatgcttcagtgaaaccctttacattgtagttatgcttcagtgaaaccctttatattaaaataatcatcacgtatttgaccatatgaaaatagtttacatctaccacatttggtttatcttggccaaaaacaattaatccttagaaaatctactatatgaataactcaataataatcaaagcatttgaattagaaataggatcaaacacacttttttgaatgaatgcctaatttttatttctcagtggaaatgctagagcatatccaatattcactagtgaaaaaggctattttccatgaagcccatgagaagatgacataagttaaacttgtccaattccttttcagggatagcatcaagaaattgtctttacccctataaactgaagcatttgaaaatcagtaatattaactgagcaaaataacttgtggcaacaggtatcagtctgggacacaatcaagatacagaaaccgggccgggcgcggtggctcacgcctgtaatcccagcactttgggaggccgaggcgggtggatcacgaggtcaggagatcgagaccatcctggctaacacggtgaaaacccgtctctactaaaaatacaaaaaatgagccgggctgggtggcaagtgcctgtagtcccagctactcaggaggctaaggcaggagaatggcgtgaacctggaaagcggagcttgcagtgagcccagattgcgccactgtgctccagcctgggcgatagagcgagactccgtctcaaaacaaaaacaaaaacaaacaaaaaaagatacagaaaccacatgctaatttaaacagagaaagtttaatatatgaagaattattaagtactgataggagagtaaccataaagatgtaagagaatctaaagggtatcctggagctaaggtagaggactcaaagaagagtgaactggaaggatttcccatcccaaggttggggtccaaacttcattgggaaaagtgtggtggaagccctctttctctacagcagaatagtttgctggggtgtcctggccggagctctggtccacagttgggctactgttgggcaagcagaaacaattctttagggcacaggtgagctaaggttggtgggtgggccttcagaaggagtgcggcactgaagtgaggatgtgtctgtgttggcagtgtgcggtgtcagtgctgggagaactgtggcaaagtggtcactaggcccttatatagaggctgtgaagtcaccaacagactgccccatctgggcatgtggctggggaaaaacaccaccagatgtcattacacaagcacgttgccaatggtccattgctaatggtccacattgctaatgatcgaagtaaaatcaaaatgtagcattagaaccaggaagagaagccccttcctcctgcagtgacccttcactgccctctactgacaaagagtaacgttatgctcacggtctaagaaaaatgctttaagtgcccaatacactatttctggttagctaccaaagagagctaagaggcaatacactggtaactgtcatgtcttgtacatgaatatcattattcatgtttttttaaaatcacagactatacttcttaacagctacatacattttatttatattcatcagaaacttactgcttattctttgcccttaactacttgtatagaccaacatggaaccaaatttgctgtcatataggctgttgatctcttcatccactagcacttttctgaaacaaaaagcaagtaatcttcgaattcacataagcatttatctgcaactctggtgttacttgacgactgacttctacctcccagtatatttgcttgtgaatatgtcttgttttttgctttagtccataagcaccttgagagcagcatttacctttgcattcttcactgtatcgtgcaaagtactttacccataacagtcacacaatagttgctgaattaattaataaaatatttggaataacaacacctaagagtgagaggttacaaaacacgatagttcaaaattcaacagttataaaaaaaaatcaaaagttaaaatacagaatatgttacagtattgaacattgtatggtaaatgtaatttactggaaagtatgaattttatagtgatcacatacttttcttaatatttagatatctgacacatgtaaagtagcaatagttcttattctgaaccattcttgaataaataagaagagaacacaacttggctaacaatttttatcaattcagctttgggtgctaacataatttaattgggaaagaataatcatttcagcaactagtactagaaaaaccagatatccacatgcaaaaggaaggatttgaaactgtggataacaatgtacaaagattaattcaaaattaatcataaatttaaacgtaagaactaaaactataattctttaaaaatatgagtaaatatggtgcacatacataaggtaataatttcttggctgcaacaccaaatgcataagtggtcaaaagagaacattgataaattgtacttcataaaaaatcatttgcccttcaaaagacaacatcaaaaaatgaagacaacccacagattgaaagaacgtatttgcaaatcatatatctgataagcgattgtatctggcatatatatatatattttaaaactcttacaagtcaataataaaaaaccccaaagaacctaactataaaaataggcagaagatttgggtagatacttgtccaaagaagataaatgactaatcaacgagcacatcagatgctcaacatcattaatcatgaaggaaatgcaaataaaaaacccaatgagacatcacgtcacacacactggaatgactataataataataaaaaaaacagataatcacaagtgttgggaaggatatagagaaactggaaccctcatatattgttagtaggaatgtaaaatggtacagccatttggaaatacactggcagtgtcttacaatgttaaacatagattcattatatgacccagtaatttcattcctaggtatctaatcaaggtaaatgaaaacatgtatccatatgaagacttatatggacatgttcatagcagccttattaacaatagcccaaaagtggaaagcacccaaatgtccattagctggtaaatggataaacaaaatgtggtatatccatataagggagtatgattggtcaattaaaatgaatgaatactgaaacatgctgttaggtgagtgaatctcaaagatattatgttaagtgaaagaagaaagtcacaaaagatgacacattgcatgattctattcatataaaatgtctagaataagcaaatgtacagagacagcaaatagtgattgcctaggactgggagtgggaatagagagtgactacaagtgggcatcaagtttctttttagctcaatggaaatgttctaaaatgagattgtaatgattgctgcacaactctataaatatacaaaaaagcactgaactaacaaggagctaaaactacaatgataatcatgtaagcagtgataattatttgattcccttctttttctgtttgaatcagaatgccttgacaattttttattcttttctcttctataggatttcaaggagtttagaactttacagaaataataacaaaaattacagcatttgattaataaatacatcttttagtaattttctttttgcctaaagtcaagaataattgttcatcttagtatgtttattaactactcttggtgttatgttgggcgttataataaagaaaaatctttgtttcaaaatttaggttggaattttggatcctactctgactaactaggtacactactgaatttacatcaagataacagtacagatagataagaacattgatttccttaagatcagtaatttgaagcttaaacatagtatgcaacacattgagagtctcaaagaagtaacaagtgccatctttagaaaatattttatatacttggtgtggtcttatcataagaagtatatacatacataccttgacatattgtactttgctttattgtgcttcacagatacagtttttcacaaattgaaagtttgtggcaaccctacatccagcaagtcaattttggtgccatttttccaacagcatgtgctcacttcgtgtatctgtgtcacattttggtaattcttgcaatatttcaaactttttcactattattatatctgttatggtgacctgtgatcagtaatatttaatgtcactttagtaattgcttggggatggcaagaactgcacccaaataagagtgaacttaattggtgttacgtctgctctgactgctccaccaacatgctgttcccgtctctcttcctctccttgggcttcccagttccttgagacacaagaatattgaaattattccaatcaataaccctactatgtgggtggtggggaggtgggaatgattaatgggtataaaaatgtagttagatagaataagatccagaaatgtagttaaatagaataagatctagtaacacaacagttatcacagtcaacaataatttattctatattgaaaaatagctaaaagagtataattggaatgtttgtaacacaaagtaatgataaatgcttgaggggacacataccccatttactctcatgtgattattgcatatgatacgcctgtatcaaaacatctcatgtaacccataaaggtatacacctactatgtagccatacaaataaaaaaaatttttttttaatccctacaatggcctttaagtgttcaagtcaaaggaagaattgaatgtttctcactttaaattaaaagctagaaataattaagctttgtgaggaagacatgttgaaacctagataggccaaatgctaggcctcatgaaccaaacagttagccgagttgtgaatgaaaaagaaatattcttaaatattcttgaaggaaattaaaagtgctactccagtgaacacaaaaatgataagaaagtaaaatggctttattgctgatatgaagaaagtctgaacaaaagattgaaccagccataacattcccttgagccaaagcctaattcagagcaaggctctaactctcttgaactctgtgaaggctgagagaggtaagaaagctacagaagaaaagtttgaagttagcagagtttggtttatgaggtttaaggaaagaagctgcctccataaaattaaagtgcaaggttaagcagtaggtactggtgtagaagctgcagcaagttatccagaagatctagctaagatcattgatatggtttggctatgtccccacccaaatctcatcttgaattgtagctcccataattcccacatgtcatgggaggaacccagtgggaggtaattgaatcatgggggcaggtccttctcatgctgatcttgtggtagtgaataagtctcaggagatctgatggttttataaaggggagttgctctacacaaactttctttgcctgccaccatgtaaaacatccctttgctcctccttcatcttccaccatgattgtttgaggcctccctagccatgtggaactgtgagtccgttaaactgctttcctttataaattagccagtctcgggtatgtctttattagtagggtgagaacagactaatacaatcattgatgaaggtgactacactaaacaacagattttcaatatagatgaaacagccttatattaaaagaagatgccatctaggactttcatagctagagaggagaagtcaatgcttggctttaaagcttcacagaataggttcagtctcttgttaggagctaatgtcaccagtgactttaagttgaagccaattttcatttactagtcaaaaaaatcctagggcccttaagaagtatgctaaatatactctgcctgtgctctataagtagaacagcaaagcctgaatggcagcacatctgtttacagcatgctttattgaatgttttaagcctgctattgagacctactgctcagaaaaaaaaaaaagattccattcaaaatattaccgctgactgacaatgttgcaaagagctctgatggagatgtacaaggagattaatgttattttcatgcctgatagcacaacacgcactctgcagctcatggattgaggaataatttttattttcaagtcttattatttaagacatacattttataagactatagctgctatagagagtgattcctctgatggatctgagcaaagtaaattgaaaatcatctggataaaattcaccatcctagatcccattaagaacatttgtaattcatgggaggaggtaaaaatatccatatgaacaggagtttggaagaaatcgattccaactttcatggatgactttgaggggtacaagattcagtggaagaagtaactgtaaatgtggcagaaatagcaagagaactagaattagaatgcagcctgaagatgtgactgaattgctgcaatgtcatgataaaaccttaagagaggaggagttgcttcttatagacgagcaaagaaagtgatttcttgaaatagaacctactcctggtgaagatgctgaggacattgttgaaatgacaaaaaaggatttagatattacataaatttatttgataaagcagtggcagggcttgaaagcattgactccaattttgaaacaagttatactgtgggtaaaatgctatcaaacagcatcacatgctacagaggaatcttttgtgaaaggaagatcaatcaacgtggcaaacttcattgttgttttattgtaagaaattgtcacagtcatctcaaccttcagcaactaccaccctgatcagtcagcatccatcaacatcaaagcgagactctccaccagcaaaaagattatatgactcactgaaggctcagatgactgttagcattttttagcaataaagcatttttaaattaaggtatgcactttttttcaacataatactatcacatacctaatagactatagtatggtgtaaacataacttttatatgcactgggaaatcaaaacacttgtgtgactcactttattgcaatattggcttttttgtggtgggctggaaccaaatgtgtaatatctctgaggtgtgcctgtatttggtcttagttcttgctgcctggcacagagctcctataacccttgttatttcctgattaatattggtgatagcagcatctttcttatatttggccttagttccattttctgacataagagcttctataatctttagaatctctggagtgcctttttgtatgctaatgagatgacaagtggctgagggcccctacatagcttcaggattgaggctagtcactagaaagacctgcatctgcaagggatgggctaggggttgaagattaagctaatcaccaatggtcaatgatttaatcaattatgcctacataatgagacctccataaaaactctaaattatggagtttggatagcttctcctaccctatactttctgctatatgtctcttccaggctgttcctttacaataaactggaaatagtaagctcttaaattctgtgagctgttgtagcacattattgaactggaggatttatagctggtcagtcagaagttccagaggcctgggtcttgcaactgatgtttgaagtggggcagttttgtgagactgagccattgacttgtggtatctgaggataatgccaagttattattgaattgaattgtgggacactcaactggctgtcagacaattgagtggtgagggaaaaacagaaacaaaaacaaaaacaaaacgacccacatatttgatgtcagaagtggtgtggttaaaacagtagtacttggcttttttttaaatttagaatctaagtacttaagagtagatatcttggcacctagtattaaatatactaggttctcaatacatattgttaaatgaatgactagtaaatgaaaaaagaatgagaaaattatttcttgctctgaccaacttcctgactgttttactctaagtcccaataaatatgaatattaccataatagctaaaagaatgctattgattaaaatgtttcctgtcatttgtcttttagcttgaacaaccgatatatatactaatcataaatataaaataacaggtgtgctataattttaaacagctacttttaaagttttgaaattgtagattaccctctgagaattagatgcatacaccaaggttattgctagagggcaagaattactacactttaagataaaacacaatggagacttggaagggtagtaggtgcaaggtgggtggatgataggaggttgcttggtggatacaatgcacattgctccagtgatggatgcactgaaggccgtaacttcaccaaaatgcaatatatcaatgtagcaaaattgcacttgtaccccacaaatatacaaaaatttttaaaattgataaaataataattaaaattgtttttcacactctaatgttaccttggtttgagatataatgtgatccttggatctcatggagaatattaataattctctttcttagataataacaaacctgtaactattcatatttgaaaaataaataagaactttaaaactgttaccacttccttacctcccttccagctatcatattatttagtatgctcatcaaagacagattttaatgtatattttaaatttcttaaaaagtttgtatcaagaactctaagaagaaagttgttttctgctgtaaagtggtagaaaaatcagaaattagttaaacaatgcaatgattttcagagagttgttcaatgttaatatataaattattttgtgcctgtttctgaaagcaggaaaacatctgagagtattaaagaactagcccaaatgggttcattttgaacaaatgatgagagaaggagagagtgaatgaaagtagtgagccaagctctttgtgtgattcctactcccagtgaggaccagaagggagaatcaaaaagaaagagaacaagcccagtgcaagaaaccatgcactggaattgtttccttcagatttaagtgttaattgactatatcttgtgtgtactgcatggactttgttggccttctgttttccttaatcaagaaaaccctaagttttgggatctgtttatacaacagatgatcttttggctattaataaaaatgtaaaattcttggtatttttaatgtgttatttaaatttacttcaaaagtaatgatgcaactaaaatgaaataaaatttccatgattatcagaataattaaataaatgtaaaactacaaggaaatattatgaagccattaatattatacttttgaactattctgatggcattaaaaaatgtttaagatgtaatatgtgctacaaaattgaaaacaccataggaatcccattattcaaacaggaagagaaatggtttagagcaaaatattaacatgttaaaagcaatattttattattgtggggaaaatcacatagattatgagatcacaaatattattttcttctttatgcttttctaaatattctgttttctataatatcaatgcattccataactataaaatatagtacttgaataatttgctaataattagactcaagcaaagaccaaagaatgcctcaaaatgagctaggcacggtagctcacgcctgtaactttggaaggtcgaaacaggtggatcacctgaggtcaggagttcaagaccagcctggtcaacatgatgaaaccccatctctactaaaaatacaaaaaattagctgggcatggtggcgcatgcttgtagtccccgccacttggggggctgagacaggagaattgcttgaacccaggaagtggaggttgcagtgagccgagattgcttcattgcactccagcagcctgggaaacaagagcgaaactccgtctaaaacaaacaaacaaaaaagaatacctcaaaatgataaaaggagaagtaatcaaatttctcagacactgaataagtaaaaacagctaacagtaataatttgaagaaaaaatgcattcagaattactttgaaaagcagtgcttaatcatagtatatataagtagttcaatactcatagtatatatgagtttagaataggagtttgggacttgcataagaaataaaagaattatttaaattattatatgcttcaagcatatttctacaaaaacagtatttgcgaaagcatcctataaaatgtaaaactgtcaggtattaatattaaaggtaaccctaaaaatgtttttgttttgtttcattttcatttaacaatttctattgagaacctagacaccgaaaacggaagtaggcagtggcaatgagacttagtcacatcagacaatatgctgcaccatattgcaaagaaggtacagtatagcagaggaagacaggggaataagcacaataaagtgcagtgggagagatgatagaaatgtatacaggacctaggcacaacacaaaaggaaattaatcatacttggggaagaagaggtcgtggctattcaccaaataaagaagcagtagcaaagacctagagatagaaacagctttaggtcttcacagaaatgcaattagttctttctgaaggactaatggtaaggtagatcgaccatggggtaagaaataaacctggacagctcatgaaagccagccatgctgaataactgaatagcttttactccaggatataacttacagtcttaaaaagtagagatgtggcccacatgtttgaaaggtcactggtggtagtatggagatcaggttctaattgagggaagggagtgggtgaacatttagaaaaagaccaatagaaacttcttacattggtttaggtgaggaaagatgaaagtcctaacaagagtattagaacatttatattttataatcctctgatttgctttgcaacaatttttactcactttatacagaacttactgaactaaactgatatgtgcagctcatattacagtaatgaaaaatgtactaacttgtgtaatgtgacaaatatcttctctatcctgcataattctgggggactcaattatctgcattataataatctcaactaatacagtgcaacaaacttaatctgaataatttatcagataatctgataattcatcagattcagtgtcccagaatctgatgaattatcaaattcatcagattcagtgtcccagaatctgatgaattatcaaattcatccttgtcataatttttttgtctcaagactccttttgattgttaatattattgaggaaacaaaaaattcttctttataatgagttcaatgtattgccatttaccatgttagaaagcagaaaaatcacaagcacatcaattaataaatttataaattataatcataaatcacatgtcaacaaaataaatttcaagtgaaaataaccatatttctaaaagaaaaagatctaatgggatgagtgcttggctaagttatgcaggtcttcaaaatattggaagatttcattattcatctgttaatattaccactaatcacatcagaaaccctgtaagttttgagaagctgttgagctcatggtggcagatgcatctttttcaaaataataattttctcttgaaaggccaaattttgtcactgacaacaaatattgtcaaatgtatttttaaaatgacagtctccatttattttcaaaaatttgtcttttcaatatctgtttgaataatcacaatttgtctctcagtcattttttcaaataaaaatagtattctatggaagtacagctagtttagcttgcaactcaaacaactacacaagtgctttaccttaagacaaccagcattattgttgatatacagcagatgttaatcatgtatactttccatttcttcatgtatactgaatattaaaaatatgtgtacttaatggtatagattaaataaaattaatttctagtgtttcgtcaaagacattcttttagtgcaactggctttaattttattcatttatttatttacttatttttactgggaatgaattacagtgaagaatacaatgacagtatagtttgttgtcactgtcttgataagtgttaaggctaggggtttcattgttcttccaaatgtcaacacagtgaaaaaggtaaataatgtttttgtatcattatgaaaatagtttggacctgatgaatcatttaaaaagtctcaagggaatgcaagagcatctgtggaccacattttgaaaataactgctaaaatcacattaagaattttttggccgggcacggaggttcatgcctgtaatcccagcactttgggaggccaaggcaggcggatcacgagatcaggagttcagcctggccaacatagaaaaattagctgggtgtggtagtgtgcgcctgtaatcccagctactcaggaggctgaggcaggagaatcgcttgaacccaggaggcggagattgcagtgagccgagatcctgccattgcactccagcctgggcaatagagtgagactctgtctcaaaaaaaaaaattttttttttgattttttggattatattctatatgcattaaagactatgaacattctgagaacatgactgtgaaaagttttttttatatgttactgaatggaaggagggttagaaatcagcagagtatgcaaaaacagagtaaaacaaaatgcctaggaatgaaaaaaaaaagagagagagagagagagagtcagggagagtaagataaagtttggtcccagagaagatacagtcaagattccactttttgctattccacagagatttcaggaagaaaaatcacactcctattttctttttctttgcttactgatttctatttagtttcttttttttttttttttttttttttttttgagaaagcgtctcactctcttgcgcaggctggagtgcagtggctagattcttcttgagtatgctcaaacttcctttttggaatgtcttccaaaggcactcttgccttcatttgtacaagttgattgaccctttaaaggccttaaatattattgtgcgacctcacagactcctcaaatcacctgaaacctgaaatgctgaggcccaggtggcactgaaatgatggtattctagacctgacaccggactgttttctccttggttttgtcccaacacactgacatacatagcccaaaatactactggcctttttaagtggcatatcacattccagggtaatatcaaaactgctgcctggtagcatttgtgaagtctcaaagtaactctttccaggattttcaaatccactgaatttcttagattgaaatatgtatgtgacagaattctcttagctttctttcctctatgaatatgtaattggaaactctgagatccggtttctcatctttattggattttttctttaatcttaaaattatgaatatttgctttacaataatctagataaggagtccccaacctttttggcaccagggactggttttgtggaagacagttgttccacggacattgtggggagtgggggctggcattagaatctcataaggagcacacaacctagatcctgtgcatgcacagttcacaatagggtttgtgctcctatgagaatctaatgccgccactgatctgacaggaggcggagctcaggctgtaatgctccctggcccactgctcacctcctactgtgcgacccagttcctaacaggccagggaccagtactggtccgtggcccagggtttggggacccttaatctgatgttactaagttacatcattaataatctatttctcctcacacagatttctttcctcacatcctcaacacatataatttcacatctccaaatgcagcattccctaataattacccttcttactccattctgccacctctggctcattttcacttgccattccatttgataatctagtaacttcattttgccaacttgatgaatttggttctaagtagtttaaaaatttaaggacatactatgtcagtatttacaggtgcttcttatttattcttcagtattctcaaatgttcaatttgaggtcaagttttgctaaaaacaactcattgcaaatagtagatgttttataaatataagataaatttcttaaaattcgtgctgagttctaaagagaaaacttaggttaccaagtaacatgattttcagaacaccaccaatttgctatttcaagtctaattttatattagaccgattcccaaagcttttccattgttacaaaattttcaaaatactgtacttttattatacaaggtttgtggcctagttttattaatattccaaaagacaaaatattcaaacattcaattgtttcatcaataatttaaactaaatttactattttgattaaagatacaatgagtatctttgcatgaaatagattactaaattctatttgaaaactaatgtacacttttattctagtttttaaggcaacatatgtttattttgaactttattttaagaaaacataccaaaacaatgccaaattgtttggtaagaaacaataccaaagcatttgaaaaaataaattattaacaataataattttgttgtgtaaaattgtgagttatttcatcattttattaatttatatttcccttttgctttatgtattacttttgctttatgtattacttttgtcataagaaaaataagatgtaatattctatttaaattttttttttgttttatgcactttatgttccttttttatgtactttatgttccttttcctttatgtattacttttattataagaaaaaataagatgtaatattctatttttaaaacaaaaactttataaagaagaaaacagaaatcctaattctataaaccagagataactattatattatcttcagggctttttctaaggaaaaacatgtttgttttttttccgtaattggggccatcctagatatatatgtttgtaaggtactttttaatatactattataacctgggcaattttatatagaattaaatattcattgaaacattatgtttaatggtactataatatttcatcatttgcctagactatgatttatttagccattctttcaaccttccagcattgtgtatgtagactgttttcttttttcttttctcttttttttttttttttttttttttttttgagacagagtcttgctctgtcatccagacgccaggccggagtgcagtggcatgatctcggcttgctgcaacctccacctcccgggttcaagtgactctcctggctcagcctcctgagtagctgggactgcaggtgcacaccaccatgcctggctaatttttttgtatttttagtagagacggggtttcaccatgttggccaggctggtcccaaactcctgacctcaggtgatctgcccaccttggccttccaaagtgctggaattacaggtttgagccactgtatctggcctatgtagactattaatctctccaattttgtttgggttgaattagttttcctatatggggatagtttggtggaaatgtcagtcaaggaactgttagttaagtttactcttaactaaaaggatcagattcatgacccaaacttgaccaaccagatgtttacttcctggaattttggtgttaaacatgaatgtcaggaaaaaaaagaaaaaaaaaaaaaaagaaaaagaaagaaagacaaagagcctgaaagcagttgagctgattcattctagattacagcaccttacagaaaccaccaaaagtctaccaactgggctatctgctcttatagttttctctgctcctggcatttttcagtctagattgtagctatcccttaactctgtgaactataatatcttttgaagacattgcttttatacttaaattaacctgagtcagtttcagttacttattgtaatactttaatttttttttaccaattccccatgaattcctaattttatatccttttctgtcactttcctcactgaaataaatgagcatcttaattcttatcacagatcatgaatgtaaatgtgacattataggcacagcagtggaatcagtgtcaccatcattttatttctgcccccactttgttagtcatcatgcctgtaattacaaacctaattaattgcctttattagaatcttaacacatacacagataactcattattatccagtaggaggagggtatgaataatgaaaatccatcatttataaaataaccacaacagtttcatcaacaacaaaaaaatatcaatttaaccttctttgcttatgattttagtagtcataagtattgccagagacaactgttagaggctgaattgtatcctccccaaatccatatgttggagtctcaaactccggtacctcagaatgtgactgtgttaggagttagagcctttgaagaagtggtttagtgaaatgagacttttagggtgaaccacaatccaatatgacttgtgtccttaaaagaagatgaaatttagacagaaaagagacaccaggaatgcacatgcacagaggaaaagacagacatcagcaagccaaggagacgggctttagaagacaccaaacttcccagtaccttgttcttggacttcgagcctccagaactgtgataaatactgttatttaagccaccctgtctgtggtactttgtcatggtagcccaagttaactaatacagaaaccaaccctatttgaatggcacacctctatctcaagttcagtagtttccccaatggtatctgtgaaacaaaagcatactagcaacatatattacaaagaacatggataatatttgtgtaactttgggaaagcatgtgcaatacagtaaatatgtttctttggaataaatataacctttccctggaaatatttgctcattatctccttaaattttcagtggagtcacaaatgaatatgtttccaataatgagaagaaacattttgttgtgaagttagatcaataaagtgtttaatagttaagggtatatggatcagttttctgattctttaaagttatgtggattctcaagaacaaagaatctcactgaccttttcttaaaagatatatccctagtacccactgtaagaaataattgatgctaaaatcataaacgcatggacaacaatgttaataagacaattcaccggggaaagaattgtcttttcaacacgtggtgctgggacaactagatatgaacaaacaaaagagtaatgctgaacccctacctcacattatatgcaaaaagttgactcagaatgaatcctagatctaaatgcaagagctaaaattatacaactagttgaaaaataatagaagtaaatttttatgacctcagattaggcaacggtttcttatacatgagactaaaagcacaagtgacaaaagaaaaaagttagagtagattcttcatcaaaattaaatctaagtttgtaggtagagcaccaaaggagaaacaggcaatatgataaggcaaagacttttgaccatttacagagaaaagctaaaatgtcaggttgattctaagttagaagagaagcaaattcacattttctagagaagaactacagtgtccataggtaactgagaatgaggggaagcaaatagtgaaaaaaatataaaaagataaaccattggaatatgagtcttgaaggaataaaaatatggtaacaaaagttttaacatagatgaaaatgaaagctgatgtttatcaaattattttgaaatcacattcctactcattcatttgcaaaaaaaaaaaaaaaaaaaaaaaaaaaaaaaaaaaaaaagatttgttcaaatccctccaagcagctcctgtgtcctggccactatgggggatgtaaacactggttttcatgcttagtgtctctttcttgcctgcacctggtcagtgtatcatttctggaggaagaaaaactgactgggtgactatatcattctaaccaatgatctcattcaaacaatttttttttcatcaaatagtaccttttcaatattttttaatttttaaaaaagtttttagacaagagcagtagtgagaagaggggaaagcgtagaacaaggagtttgatctgtaactgactgtgaacaatcaactgagataactcactacctttggatcagttcttttcaacatttttgaggcaatttttttgcattctaggaactgcaacattttttcagagaactttacaaactctcaaaacttttttttgtgaaaatgactgatttatgttttttttaaacctaataacttgttaacattgaatgttttaaatttatttgacataactctttgatttgtttttttaaaagtcgggggcagttagagccctaagcccaatctctgagattccacagatctggctgcacacctctatggtgctatttctgttcgtttcttttactttcaggatcacccacaaggtttgtgccactcttcatacctgtgaggcacttcaccctttagcacctttgattcaatccatcattggcctcattagatttctgcttaaaaaaactttttctccacctctttcattattttctgtttgcatgcccctctcatcctcactatctctttatcttgcagtatttttcttcaaagaacttacatttactgacatttctttgcacattgatttgcctactgtccaactctatcaccagactgaaagctgcatgtgggtaggaattttgctttattcaccacattcctgcacttagaacgcagacccttctatcttctattgtacaggagagcttttttttttttaattttttaacaaatagcccggtgtgatggctcactcctgtaatcccagcactttgggaggctgaggcaggcagatcacttgaggtcaggagatcgagactagccgggccaacatagtgaaaccccatctctacaaaatacaaaaattagccaggcatggtgacactcgcctgtagtcccagctactggggaggctgaggcaggagaatcacttcaacccgggaggcagaaattgcagtgagccaagaacgtgccactgcactgcagcctgggtgacagagtgagactctgtctcaaaaaaacaacaaacaaacaaacaaacaaatggagtggatttgggtaatcattctaaaccaaactgtttttggaattttggcatgtcagaaagcagatgaattacagctcacatgtacgactgcacccaacttcagtcctgagtctcttggctaagctgtagctctaccatcacatggatgatgagcaaacatcaagaacacagacgccatggccacggtgtggctggactgcttggattctgccacttactaactgtataacccagcaagttaattgaacctcactgtgccttggttttgtcacctgtaaaattaacaatagtatctacctcataggattaaatgagatcatatttgcaaagtactgcttaggatagtggctggcacagagtaaatgctatatgtttttgataaataaaacaattaataaatggaaatctaggaatgtggacaaaatttaaaagttggaaaagcaaactttggggcagcttggggaattctgtcacaacttatttttctgatcacaagtgcaatgagaataaatttcttcccaccctaccctaaactaatgcaatctcaattgagcggtggaacatgcttcattcactaattagaatttaaaaaggaagtgataacctcacggagcacagccccattgaccctgagggtgactatacaggaccttcaattgctgattctctcccatccttctctgggatctgtttctcccaccctccccattctgaggtagctggaagagagtaggctttgtgccctttggcgagtacagggagaaaatagtaggttcagcctctccaactgcccagggagaaagcaatacctttcaaggtccccaggctaaattttggagggatgcttttgtgtgtcactgtcaggctcacaccgacataaacccttgagaaatgcctggttggtgacgtcctagaggtaacaccaagcaagccccagattttctcttcttcgtcagcaattcccagatgaggtgctcttgtgtttaccctctctgattgtctggattccctgatagtaccctctatacaaggaactagaatgtttcttactggattcctctgttggtggtgatagagtttactttgggtatctagtcggtctggttgcccctggtatctctggttggtacaacagaatcctgactgagctccttagtgccttcttgaatactgtataattaactaggcctccaattgtgccccgccttgccccagcccatagatggacaatccctcctgccatgtcttaaagagaaattaccataataaatgactctccagacagcacatttcccagcaagagggggcatgtaaaccaagtctattagtattggcagcaaaatccaatgtgttattgttaccagtatgaacactctgggtatcctggcctcctatatagatatttgaaacaaaacagacaaacaatgtgaaggaaggaggaaaaacagccacacaaatgagttacagtgagtttaatgaaaactaattccattgctgggtccatgtgatataaccagccacttgtgctctgttctagtggtttataatgttacctcaccctctccaagaaattggtttcccgtaaatctctgtggccattcattcctgtctacacattatgttcctaaaatagacaccagctaaaaatctcttccaggagctttgtgaaggaaggcctaaattgcaaaactcctcctagaagagagatgtgattttgtaattgcttcattgcaattacaaaagcaacaatcataaaagagagttttaaaagagtttttcaccacagtcattctcctgaaatgcacagctgagggaaagaagaatgtcagatgccccgcgaacgtgcagaagctcccagttgcatcaccctggcgtgccaggtattgcagcaaataggaaaggtaagctacccacttctctgggcaggagaaactaaagcaggaatcaccaacctcagcatggaattttcctatttctgtctggcaacatcctcttgggatgatttaaagtgctttttggagaaatatgttctgttactatactagcgcatcagaaataccacgtgaacctgtaaatccatagaagaagaagacacattttataggtgtgatagcaacagcaattggcaatttgcaagtttgctactgcactcagaaatatttagtcacatgcacatattgacagtaatataccctgccttgacttaattgttgcattggacaggtgaaaagcacatacccaccactccagaccgatttgttaacaatcaccagtgagtaatcaaagagaacaaaaagaaatgagaagtaaatgcagcaagtgggtcgggtctttaaacacatacctcaaacaggtaggagtcaggaaatccatgatagcaaagacatttggacaagcctcacctccactcagaaataattcttatgctgttctgaaaagcaagacggttcacactaggaactgagcagtatctgcagtatcattgctggttgtgacctctgtctaagtaaaagtaagtcaatgtttcctatttggcattggatagaaaaggggactctttaccactctgctcaagctcttttttagtgtggctcaataggagttggcagaggtggggggcggaaatcattgccccttccttgttcaaggcatgaggcatttcttctcaaaagcccagcctcagcctcaggaagctgaatacccctgcaatgctaggctccagcagcagccccgctgccttctttcttcctgtggagttaaaactgagatctaatttttgctccgtccttaagaacaatatgacctctattcccagccagctagtccacttccaaagcaccagtgaaggagggggcttcaacaggatcaaaagggaccttgaataggatgaaggcaagcaaaggcaagaactggccagatgccaagctatttcaggccaaagaatcccatcttctatcaaaatgctgaactgcaaaacaaacctgatttcagttcatggaaggttgagagaggaggggggaggggaggggaggagaagaggaggagagggaggagggggacagttggtctgaatacacatacaaaaatggacttcctgctctgcccaaactgaatttccatggactctttttccaaaggaataactggaatgaataaacttaaaatcaagatgaaacaattagatggcttacctgattaaaaggaaaattatccatctgcagtgaggaacagcatcacccaaagacgagatgataacaatgtgccttcagttgcaattgttcagattccttcttgcaaaaggtgtcaaagtatttacaagggctgcagtctcactggggcagaacacacagacacacaaacacacacaaacgcacacatacacacatgcaccagagacctctgcagtatcctctcggcttcatcctcgcctcactctatggtacctaatacaaatcagcaaatagcttgtttcaaaaaaaaaaaaaaaaagtcaagacagcaccttacattacatcgccatctagtggctaaatattaaacactttctcacaatccagatttatgatttcttcctcaacctcttttctctcagccttttttcctttcttctctgtaatctcccagtattgcttctccttgcttctctttcattccctattgctatataatatcatgaacctaatgactcaaagaggaaaaggtttgaaagtaaatatagctattttcaagtagtacttgaaaaactttagcattattttagtttgaaactgttactttattcctaatatgaatcattgttatctataaaaatgatatatcttataaataaaactgtctttttattccaccaggaaacaatcaggtggccctttattacagatctatggcttcacatttttctgttttaatattgtgttttaggattaggtttcatattatagtgaacagctcagagtcacaaaatgtgagttttacttcaacactgatgaacacatgcctttaacaaagccactgaagtcttctatggacatttacattcttactatcttcatctgtaattacagattaaacaagactttcaacccactctcaatttctatggttttactatattttactccaatgttttcccatcttgtggacacagcctaaagcttaattataataacacattttaataagcaaatatatatagaaagagagtccaattgcctattacccaaagatagaattataaaaaccatgaatatcagttttttctaagacaataaaaatccatgccaaactaattataactcttggaactgagagtagagctttttatgttatatattgtattctaaaatggaatcagccttaaacattcagtcatacataaaatcacgattatgtgtagattagtcattggaagtaaatatttcatcctcattatttttcttttgccatctaacacacttattacaatcattgcatgtgttttatcatttatcaatataaccttcaatatttaatccttctcttccttattacaggatggtgagataaatactattaatgttattatattataattattcctatttatacttgagaacactgaagctttctgagccttactgaggtttattcaagaccacatagcttgcaaagcaataaaactaaggctgttggtcccaagagcccaaagaataatccactgttctttgcaacatacctaaaagttcaccattttttcctgttctagaatcacagaaaagtaattttgatttctatgtttacaaaacatttactagcccttaattatggaccaatgggtccatcttgtggatccatctttttatctataaaagaaagaaattaagtaagataatttcctgttccagctcaaaaactctatccagtgctttcccaaaagccagttggagtagcatgaacacattcatttgaagttactcaatgtctgggaaatgatgttgcccagtatctggtagagtcagggcaaagttgaaagaagatgaggagacaggtgatcaacaactggtaaacgattgccaagatgttagagatgaaaagagagtgggaactgcatgaactaacaggcaatttttttagaataatacattccatatgaatagtacttagagattagatatgtaaaaacacaaaataagaacatacctggccacatgttttaatgaattctaattgcatattataggtgccaatttttctgagtgtctgctcttaacaattcccccaatagttcttctcccctgatccttagtggtaaacctaccctcttgctacagaggactggagcaagagagggtatctacgcagctgacctggtcaaagagagccactacatgtgattctggcagctatggagtcagctttccctcaccatggggactcaggaccaggtggaccaggatactgaaatagcagccagccacacagatgtggaggaagaagtgacaaaagacagagacagactgtttccatctccagtctactcaagatccaaacactttcttgatgttgagtcccatgataaactcaaactccatgtttgcttaagtgaacttggtttctgttgaactatggagtcctaaccacttcattagcttcaagaaagttgccagtactgcatctatcaagtattattcatattctgggcatctgacacttcatttattcacttcttcatgcacctgatatatgccaggcacttttccagatacttaagtaacatcggcaaacaaaccagatcaaaaccctccctttgtggagtttacattgacatgtcagtcatatggaaaggcacaacgcattcagtgtgcacactacctttcttccgcctccatgtctttgttcacaaccttcacttctcttggcagacctttcatccatctacacatagcaaattcggcggatattttaaatgtctgggtcaaatattctctcttctccaacgtcttttctattttctcagcagatagaattcttttttcttttgttaattatagaacaattttatgttgtatcttatgaaacatggtcatttgacaagttgaaagcattgagcataaggagataaatgactattctcatacagactcctagaaaaggccaatatcccaagcatggcccaaagagtactattaactaacaactcatcattctgtacacagatacttcattcgtcagagctgaagcagttttacagtattagtaactttaaatcttccatgtttcagactgagcataaaggcaaaatatgagatttttattaaattagtgtaatatgcacttaaaatcacatatttattttttaaagttagcagaagatattaaaacaaaactctgtgctaccctatgtcactactacacttatcccatttgaccttgttctaagagttttatatatgtatcttatttggctcccagaatgtaaactccctgtggaaccagctttgcattttatttatttttttgtagattaatttattgagagataattttgtctctttctcactgttacgtttccaacttcaaaaaatgaaaaactaatcttcctctgcccccgttggtaaagttagccattccaggaacccctttgtaatcttgtttcagaagctggaaaaaattagctgcctacttcctaggtgacaatacttcaatctgtaatgcatgaacctgctaaacaggctgagggggcatggctgtggcttttttatgagagttcctaacaaggaaaagagaatgaaggcgtaagatgtcatttagtctttgtaagactccgtctctgtaagactccgtctctgtcctgtgaatgtggttgttactttgttatagctctgtcagttgcactgctcagtgccaaaacataaaagggaatattataatgggacataatctctgtcaatagattttgggtattaaagagagcgtgaggtcactcaggtggaaaaagctgggccaggtaattttgtctgttagttttacgacataaaggagagtctctcgatgccattagatcttgaaagagttcaaagagagaactatctcattatcagaaggctgaggaattagtgtaattagtatctgaatattctttaatattttcttgcatagaaaataaaggtaattggttatcaaaaatattctttcaaatgtgtatctcctggagttgtggagttctgaaactttaaccagctgccttatgaagagaatttattaattaactttatgcctgccaaggagaaggaaaccattcttaatttttagccaaaaatttcccaaagtgatgaccaaatcattatgttttgagttccagattcccttgtttagagttataaatgacatttgagttttaaggcagaaatgtttctaaattcccctgtcatttgtttgggaatctatagtcactgagcaacatgaagctgggtctcccctctcttcccaccgcaggaaaggaattggaggctggaggcgaacttgagtaccttgaggtggtatcccaaaggagatggtggtgacaacagacaagtctagatgttagcaggtcttctgatgaagtcggggagtgatcccaacacagatagcaaatgctagagtttggatttaaactcagaccttaagattttagatctacaggaccactgtatcactacaaatcctgactttgcccccttttgattggaataatcagataaagcacactactgatgtgatccttggtaaatgtaatttactacttaagtactttgcttttgtagatgtcaatttcctagtggtttttttttttcttttggtaaatgcagcattctgcaaaaatctactaccaattccttgctctcacaaagcattcaccaacactgtgccactattttagaaatagaaaccatatcctagccgaaaatgataaactcatatatttccttttgagattaacctgcccttttgaaagggagtcagaaatgaatgtgaaatttatttgctattagacaaataaatgcagaaactgcaattaagaactctcttttaggactagagccaactagtttttctgcaagtttaaagttacaattttttgatggcaagaattggccaactgatttcaaaatatcttataggtactaaagtggacttttgaaactctggtaaagtccatacattccataaattaaaaaaataataatcagccatttttttcaaatatgatataaaaatatctgagggctcctcccctccccgcaactggaattcactgaatcagagctgctataggcttgcattttttgatgcacagataaccagtttttaaatcacttgtaatataatgaacataaataattgaatttttttttcttacagatttgattctgaagtatttttgaagtatctttagaaccaatgtgcttgtgggcacacattacactatttaaaattttattaaaagtattttaaaaatccttagagagagaatgccagttatctctctctctttctggtagtggagaagaaaaaatagtataggcttttcttaactcaccacaatgcagtaattaaaagcaaaagagaaaggagggaagttgtgggattatgatggagataatcagattccccagttgccctctgccttccctgctatcgagacaacgcacagaagccagaattatgtctgcaggtgattatttcagggaagcagttactccttgttggaagattcactgcaatttcctttcaattacataggcagacattggtgttggagagggaaataacaatattcctaaaccaaataagtagcttttataaacaagacagaataatacatgaacctgatttctcaaagggaaattaagtatatgaatgtcaatcatctgatgagattagcattacaatataggttcagaatgagtattaaatcacaaaattactttttatcacttgatgtaatagcattattcctctgattatatcaccaactgaacagcacttcaaaaattactatagtgctctgtatatatctttaattttaaatcctttattatttgggggcctggtttatttttgatcttttcttctttagctaacgtgtaagaagacattattaatatttagtgaagatgacactaaatgtcgtttttcaaaacaacaaactctgccttttcctaaacaagcagggagccattatgccttcactgttccgcttcctttgtttcctctgttttcaggaccttctcttctttgaccgcatcttcctccaccctctatcggtgcacctctccacggtctgaccccactcaataatctctttgaaagtaagaactatgacttattttttttgtcattgttccccaaacatatcccaagtctgtggtagaattaaggtagtttctggagagaacctgataacatctgctgagtattgatgaataaaaattccgtaatagacttccaacaaaaccctggagtagaataaaataactttgtaaacctcataaaaaagaatgtcaatttacataaatcattaccattgctttatcgatagggttttgctaatcattgagaaattgtggagctggaaaagtctcagagataaaccaggcaagtgttcttattttggatatgaggaaactgatgccaagagaggtgcagtgacttgtccaaggtcacatagatagttttataccacaaaggtccattcaagttttcccacagtttaactctaaaggaaattaatattgagtaaggtacatcagcacataagaagcaaaatggaagtgagtgaagtatttctagatatgccacaattgattttcactcatgttttgacagagagatggatgtgatgaagggtatgaatgcagttactgtttaagaaggtgatggactaaccaacattggttttagcaaagaataaagaaagtgactgtccttcaatctagctccacatgcggttcttaaatattaaccacaaagtactcaagcccaagggcacgagctctgggtatgcagagtgtagcattgacagctttcaggaatgcaggcccaaagacagctccagaaaatatccaggaagcaaactatcttgaagttctatactttctttgaaatgccaagatgtaatctaaaaatatgtgttctacttttttagtctaataaaccacatttatatgatggttatctgtcatatggggagacaaaattcaacatttcacatgcctgagctttatacccctcctttaaatgtatcaagatttcataaagctttggttcttcagaaaagatcaaggtacatcacaatatttaaagcattatctccatatctattgccacaggaggataaagagaaaataaacataaatgcaaataatgaaaatgcctgagcaatcataaagaatgaagttactgtgtggattctattctgtgtttatgtgttctttcctttgctcttaagtcagttaaacataatgcttgggttctttcctgatttatttcattcagcaatcccccctaccccccgacatcccttgcaaagatgaatcaacaaaagctattaccaagaacaatatgattgattacttattggaactcgaataccaattttccacttaagtatatctttatatcaatcacctcacttgcctacctattgaagagtttcaattagatttttttaataaagaggactttctttactctaaaggatatagctgatatttatgaagacaacgctttatttacagaataaaactgaactttgccataacttagcataagcaaatatgtagtttctgtttccctaaagaattcctgtcaacatctttttcctttcatgttcaaaggcagaaagtcattgactttaccaggagcacagcaaagccatctgtaaagtatacaagtgtcgctagaattaggtgctaccatatttcttggggaaattaacatttttgacacatctgtatgcagttccaatcttcggatatcaatttacaaactcacataaattacatttggttacatcttttctttttgtttctttccttgagaaaagcaagaattctactctaggccaaataatggacagaaatcattagggtccactccagggactgaggccctttagaagagattggcaagtgactagggaaaaggtacatcgaaggtcagaaaataatgacatttagcctagttctcctcgtgattccttggaaattttggggcccatgagctcagttgctgcttctgggattgcccctattcatatcaaatagcagagaactgagatgtcttacccacacctgagaagattcggatgtgagcatgggatagaggtgctaggcagcggcactttcatgcctaagtgcagtctctcatacctgttcatctgcagtggcatgaaaggcaaacagattcttctgctcattatgggttgttgaaatgacagaaccactttgtctcaacattttctatgacacttgatacataaggaagctcagagactaaagtccttgtttccatgttgcactaggtctttttgaaagtctcttttacattctgattgctatcatgacatcaaagtcacctgtattcctcatctttgtggggaagagcaggctaaataaagtaggtaaggacaccttctgagtctgcacccctttaattgacacataggggatgtgacccctgacgtttctgcttcccttattctttctgcaactaagcaaacatagaatgtggattttcccatgctcttagcaaggatgaaactcagcgatcatttgctctacttcacatggtagttgtttctaagattacatatcatatatatgcatatatatatatgttatgttatgctacacacacacaactgctaatgagtgttctctctccccttttcttgtccctctgctctctaggacagcagtagctttatatgtatctctatctgccctaagtctcctctcttgggcatcacaaacagagttacccttccatgaaccatttgttgctttaaaattatacctcagatgcagtcatggtcctagcagaaagtagatggtacattcaaaatggttaaaataaaaataattatggagaaactattgaccaagtgggttaagatggttgatgagtgcccaggaactagcaatagagagagccaatgccattccaggcaagagtgaaagtggcaccagattccggtgagagctagagctttagaagacccaactgagaggtttaactaaagaggaatgcagctgcttttttaagctaggaagtgaggtgtggtcggggagactctccaattttctgctaatgcctgtcttgggctgcattcaaagccaacggatgaaggaccccaagtttctcaatccctggaaagtggacttgaaagtctttccctctacttgtccattattccacttctaacctacattttaatactcccaacactctcttccctggtctgcattccttggagtccagtgctcctgctagtagcccttcttccagggctccagcatttgttgggctctgggaatgttttttccaggttggcagttgtgaagggctggtgggaactggggaaaataacaatgtgtctcatcttatctctaaaaacatctctttttctttgtttaaaaagcaaaacacatgtgtctaaaatattttacagagatgaacaaaaatctttatgataaaagattctatttaataccctaacccttaatacagtgcctagtatatggtagtgtatgatatggtttggctgtgtccccactcaaatctcatcttgaattgtaactcccacaattcccatatgtagtaggaggaacctggtgggaggtaattgaatcatggtggcgagtctttcctgtgttgttctcatgatagtgcataagtctcatcagatatgatggctttaaaaatgggattttgctgacacagctctctttttgcctgctgccatccatgtgagatgtgacttgctcctcgttgccttctgccatgattgtgaagcctccccagccatttggaactgtaagttcaataaacctctttcttttgtaaattgtcatgtctcaggtatgtcattatcagcagcttgaaaatggactactcagtaaattggtactgggagtggggcactgctaaaaagattcccaaaaatgtggaagccactttggaactgggtaacaggcagaggttggaacaatttggagggctcagaagaagaaaggaaaatgtgggaaagtttggaactccctagagacttgttgaatggctttgaccaaaatgctgataatgatatgaacaacgaaatccaggctgaggtgatctcagatggagatgaataacttgttgggaactggagcaaaggtgactcttgttatattttagcaaagagactggtggcattttgtccctgccctagacatttgtggaactttgaacttgggagagatgatttagggtatgtggtggaagaaatttctaagtggcaaagcattcaaggggtgacttgggtgctattaaaggcattcaattttaaaagggaaacagagcataaaagtttggaaaatttgcagcctgacaatgcaatagaaaagaaaatcccattttctgaggagaaagtcaagctagctgcagaaatttgcataagcaatgaggatctgaatgttaatccccaagacaatgaagaaaatgtctccagggcattcagaggccttcatagcagctcctcccatcacaagcctggaggcctaggatgaaaatgtggtttcatgggccaggcccagagttcccatgctgtatgcagcctagggactttgtgccctttgcctcagccattccagctatggctgaaaggggccaacatagtgcatgggtcatagcttcagagggtgcaagcctcaagccttggcagctcccacgtggtgttgagccggcaagtgcacagaagtcaaaaactggggtttgagaacctctgcctagatttcagaagatgtatggaaacgcctggatgcccagcaaaagtttgctgcaggggtggggccctcatggagaacctctgttaaggcagtatggaagggaaatgtggggtcagagcccccacacagattccctactagtgtaccacttggtggagctatgagaagagggtcaccatcctccagaccccagaatggtagatccactgacagcttgcactgtgttcctggaaaagccacacttaatgccagcctgtgaaagcaactaggagggagtctgtaccctgcaaagcaacaggtgtggagcttcccaagaccatgggaacccacctcttgcatcaacgtgacttggatgtgagacatggaatcaaagatcattttggagcttaaagatttgactgccctgctggatttcagacttgcacagggtctgtagttcctctgttttggccaatttctcccattttgaatggctgtatttgcccaatgcctgtactcccattgtatctaggaggtaactaacttgctattgattttatagcctcataggcagaagggacttgccttgagactttggattgtggacttttcagttaatgctgaaatgagttaagactttggaggactgttgggaaggcaagattggttttgaaatgtgaggacatgagatttgggaggggccaggagtggaatgatatggtttggctgtgtccccactgaaatctcatcttgaattgtaactcccaccattcccatgtgtcatgggaggaacccagtgggaggtaattgaatcatgtgggtgggtttttcctgtgctgttctcatgatagtgaataagtctcacaagatctgatggctttaaaaatgggagtttgcctgcaaaaactctctttttgcctgctgccatccatgtgagatgtgacttgctactccttgcctccagcatgattgtgaggcctccccagccacgtggaactatgagttcaagaaacttgtttttcttttgtaaattgcccagtgtattagttcattttcatgctgctgataaagacatacctgagactgggtaatcatggcagaagatgaaaggcacatcttacatggcagcaggcaagagagaatgagagccaagtgaaaggggaaaccccttataaaaccatctcgtgagacttatacaccaccacaagaacagtatggggaaaactgctcccacgattcagttatctctcaccaggtccctcccacaacacatgggaattatgggagctacaattcaagatgagatttgagtggggcacagccaaatcatagcaggtagagactcaggaataaacatatggatattcaagcagtactatttttagataaattctaagaataattttagaataataataattgttgttaattttattgaggacttaatatattttgggaccttcaaacctcacaacagtctcataaaatagttgctattaccatgttatcttcatgaatttataaatgaggcaactgaggctcagagtagttgagcatcttggccaagatcacacagtaacgaggtgactaagtgtgattctgaaaccagcagtgtatctccaaagtacctaatcttaccataaggccatactaaaactctccacaatatcacattattaaaattatggtggaaagtctctgcaattcgagttcacaggcaaacaaacagaagacaatagtctttctttactgctaaggattacatcacattaagctcatataaggacataatgggggagagacatttctacaagtagctgaccgaagatagtttttaggtgtatgatcagtctgtagcctggattcttgtcaaacatgttagggggcagcatgtggcagggtgggagggaggcaaatggagatcttccttcttacttgtctcagattcttcaatcttccatagcaagtgaaagaatataactatgtttggacgtactctcaccaagttaacaaatacactaaacacatgagtagtgaggggagaagcatgcctcaatctggcaaagcttcaatctccagaagtctaaatttgttagaaatgaaaaagctagcaaagcagaactgctgatcgtgaacacttaacagtaagcttcctttggtggaagcttcatgttgcaaacatcgtatttaattaggtgtttttttctcagctcattttctaaaaacaagtgcttttcggctctgcttgatgtttgtgaagacacggaccgcgcaaaaccaggatactttcagaattttaaaaccttgcttctgaaagtgtggccacatactggcagcatccccacttcttgggagcttgttgaaaatgtggactctttggctccacccagaccttctaaataagaaagtgcattttaacaagatttccccaggtgattctgtgcacattggtgtttgagaagccctggctgtcacatctggcctcagctcttaaagcctactcacttccttctgcaccttgaacatgtaaatcagccattctgccctgctcaccactccccgggtgttcccattcccctttgcagccctgcttgtacatactatttagatacaccaagcaaacccaatctactcttctaagtcacatttctaatgtcaattgacttgagtggctcttgaagtaaaaattaactttccagtttctcttccctcaggcccagtctgcagtggcaatcgctgttaatttttttttttttatcttctttagaattcttgtgtatatccaagcatctgaaatatacgtgttttatatttttcttttttttataaataacattgtaccagacaccaggcatggtgtttcacacttgtaatcccaacaatttgggaggctgaggtgggaggattgcttggggccaggagttcaagaccagcctgggcaacatactgagaacccatctccacaaatatttttttaaaaagaaagaaaaacatcacacaatatatatggctgtaaacctagtttaagttacataatttatctctaattagttcacttattattgcttaaaatattttgttctgtatatagatggatataccaaagtttatttaatcagttctcagatgataaacacttatgttattttctttctttcttccttttcttttttttttttctatttcaaacaatgcggatgtatacatttctttacaattgcatttcccacttgtgcaaattttcctttaagatctagtctcaggaaatggatctgtcaggtggaagggtatgtgccttttaacccagtaggtatcaatagatttccctccaaaggtgtggcaccattttatattccagaacagcataagaaactgtttccatcaccagaaattatcaaacttttttctttgttgactgggaagtagaatctagactgtcttaaacttatctaggaatttctctgaggcatttatgagtagacacaaagagggtggaggagaaagaggaggtgcattctaagaagaggagatacatgtaggatatatgtaaagttgggtctgtggaagtggctagagtctggagaggtaggcagacagccagatcagaagggcctggcacacctgctaaagagggaaaactggaaccgcattcccaaggaatccatgaaaatatcgtgttgagaagataaaaccaaatagtttgctttttatttccacaagtttggaggagccatctgtttcttgtcagggcattgactgataatagttgtgtctttataattgggttgttttctcctaaaactcaatttagacaaagtaagtgtcagtgtgggagggttggctaattgttaggaagcaacatttggtaaatctggaggccaaacccaaaacttttatatttttatattcctggttgtgcttactactataaagttaattataatgcttttactagaagctgtacatttgaaatcaaaacactctatcactgctactttcccttctcccagcatgaggtaacaataatattctttaggaaatttcatatggaaggttgacacctgttgtactttccttacctctctgaataaaataattccaacagaacactgacaacttttagaaatccaatttcactgtttcacttgctgatatggtttggccgtgtccccacccaaatctcaccttgaattataataatccccatgtgtcaagggtgaggccaggtggagatacttgaatcacgggggcagtttcccccatactgttctagtaagtgaataagcctcatgagatctgttggttttataaatgggagttctcctgcacaagctctcttgcctgcagccatgtaaggcgtgtcttttcttttcctttgtcttctgccatgattatgaggccttcccagtcatgtggaactgtgagtccattaaacctctttcctttataaattacccaatcttgggtatgtctttattaccagcacaaaaacggactaatacactcgttgaatataaaacagaaaaaggaatgccactttatcagagagctataatttcatttgaaacaaaacaagaaagatttattttttcagaactcagcatttttttttttttttttgagatggagtttcgctctgtcgcccaggctggagtgcggtggcaggatctcggctcactgcaagctccgcctcccgggttcaagccattctcctgcctcagcctcccgagtagctgggactacaggcgcctgccaccacgcccggctaattttttgtatttttaatagagacggggtttcactgtgttagccaggatggtctcgatctcctgacctcatgatctgcccacctcagcctcccaaagtgctgggattacaggcatgagccactgcgcctggccagaactcagcatttttatcaaacaaattccagatcctaagacatgtgtgactaaggatgtattttggggtaaatgaggaaaacaaaaatgttgagacctttacttatcttcaataatcaatgcatctccaaaatggcgctattaaatctaatcatcttggatttggttgatatttggatggtcatattgccgagctaaactcctttacctagaatattataattagaaaaaagtctgaggaatcatctaattcaggctctcagttgacaaagaatttaccttactttggtaaaaatttgtttggctttatgtggaggtttctcaaaaaactttgaataattattttctgaaataatattctaaattggaaattggaataaaagatcattcacgttcatcttgagtattcactttaagactaaagagggaagtgactttgtgatccaggtttgtgacattgtattttaaaggaggaatttatatttgatcttgggaacaatttttcacattcaaagtctgagaacatctccgtatcaaacccaaagagattttctcaagtgaaataaagtgaaacaaagaaagtagcattagcagttccgagttgcagacagttctttttaaaatttgttttttggttcttccaggcctcatttgcaagttgctacttaattaactagggtggttaatgttaggtaaagtccaaaatgtaaaggaactacatagcaataacaatatttcagtatttcttcaataaaagttactgacactctctatatgtcaagcactggagggtgccagtgaaaagagatggtctgttgctatgttctgcattttcgttggtgaaaacagagaagttggctgggtcatcagtgtggtacctctggtaaagctcaagtatagggaaatttaattcaatctcatgtttgaattattccctcttaagggggtaataatcctattcccatggagttttttgagggcactaagtgatagaacacatgtgactatgactagtataataaatgatgtattaaaatcattctataatacatataccggaaaattaattaagcatatgatacgaataaatgtatgataagtcaggtaaaatgcattaatcctaggaataaaacaaagcactggtaatctctctgaaggtcttagagcaggaagactcttgagacaggtctttataaaaaatcacttagaaattatacttaccaatgtgttcaaactacatgaactattgagttttgctttgtaggatagtggaacgagaagtgaatttggcatttggagaccttgagcctttattttctcactgcaaaatgacagagataatggggcctatcttttagagttgctatgggtctcagaaaggatcatggttttttttttttttttgagacagagtctcactctgtcgcccaggctagagtgcagtggcgtgatctcggctcgctgcaacctccgcctcccgggttcaagcgattctcctgcctctgccttctgagtagcgcaccaccatgcctagctaatttttgtattttttagtagagatggggtttcaccatgttggtcaggctggtctcaaactcctgacctcatgatctgccagccttggtctcccaaagtgttgggattacaggcgtgagccactgcacctggcctaagtaatttttttttttttttttttttttttttttttgtgggggacagagtctcgctctgtcgtccaggctggagtgcagtggtgcgatctcaggatttcactgtgttagccacctggtctcgatctcctgacctcgtgatctgcccgcttcggcctccccaagtgctgggattacaggcatgagccaccactcccggcagggatcatgtttttaaaattacttgaaaatacatatatagtcattcaagtatgaggtattattattttaacagaaatatagctacctatatcttatattaggttccttaatccacatatatctcagaatagcacctaatttgaattgtagaatagtatattgaaaagaatctttaactgttggagaaaaatttgtgtgtgtgtgtgtgtgtaggcgcacatgcatgtgtgtgaggcttgtctacttctatcgcacatatcaggtcgagaaaatgtctgtactaaattgccaagtggtttaggtaaaaattcatgggaaggtataatttaaaattctgagactctagcttgtaacatttgtaattttaaggctaaagacatgaaaatgaacttaaattcaatattccttccaacagcctatgattttataactttatgattataccatatgaccccaactgccttctatgtatggtgaatggttctaaattgaaggccctttatcttctaaactctttgatgagtttgggcatctacgtctggatataagagctgtggagagatggactactttccatactaagaagagaaaaatttggagtgttcagatctctcagggaggggatgaggagcagagatgggatggggaagggagaaaatgcgggtagaagcccacatctttaataaaatttattaaattgaaaaggtgattggtgtaggtaagtctctgttaaaaactagggacagacagacactgggtcacttgacagagtggttaggtgtagtatacatgaaaccacgatgccaggacacagaggatgatgtaagactaagtccctgataagttgcagaaggttttggacttccactgactgtggtattggtagatacctgagcaagatatctgccaacagatatctaccaatagatcgtcacctagatcttcaagggtgcaaacaggtcccaccttatacctgagttatacaagtaaaacatgtcttcatttatttataagttttaacctacctacttccaaaaggataaatgatatatttgttgtattatttattatgatggaacttttcatagcggagctaatctaggtcagtggttctcaaatgaggaggaggtcagttttgcctttggtagacaggtatcaatgtctggaaatatctttggtcatcacaactgagggtttctatggacactttgtgggtagaggcaaggaccctgctcaaaattccacaatgtctgggacagaccccacagcgaagaatatctgacccaaatgtcaatagtactgagttgagaaaccctgatgtaagccaacctctcatcttaataaatgagaagctgaacatcaaagagggtcagtgatatgtgccaaatcacacagtgaacaaacagataagtcctctagtatttttcccattacagtatttaacttctaagagctaaagttctaaaatggaactgttggaaaatagaccttcttatggacatatttagacttaaggtatactcaataattgcataaatctttaaaacatagtactgcttacagtaggatatctaggcaaagatgaacatagaaaatttaatgacaatatgtatttaactatatacagtaaaaaccatttttataatatttaaccaaattacttcccagcacagtggttctcagacttcagcatgcctcacagtcacctggaggaaaggcttacacaaacacagattgccaggacccatccctagagcttctgactcagtaagtctgtcatgaggcccgaaaacatgcattcctagcaagttcccaggtagtactgatgttgctggttaggagaccccactttgaaaaccactgtcctagaatttagtaggtacttagtaaattttggcttaatattgtaaatattcaaacaatataatctcaccaaaaaatgtaatctcactttaacatagattagttaataatgttaattcccatttagaggaatacaaagatatatatggtagaatcaaaactaatttaaacctcatttaattcaaattccccattttaaaatgaaaaaattaatatattttaagcttattacaacaaagaagaatcccttttagcaatagccaaaagaaacaatattaaatgcaaatcaattatagacaatttgaacactgacattgttatctgaaagatatataaactcaaagattataagtacaattaagtatgtatccatcattttttaacttatgaggaatagtctgaatgccaaactgagtaaaacctggtctgatggggctcttatctcaagctatgtctagggaaaatgcctattgacttcagtaatataaaatcaggccccgagggaccataattgtctctttaaattatttgggaaatcatgtacatgtttaatcaactaaatacagcatacaattgtaagtggtatattttcatcataaataatcaatgtgctgctgttaatatggttaatagaatgaaaagtaccttcaggggaatttattttacgatcactcattttcattcctttaatttaatttttaaaatgcaagaaattttagatactttaaaactacctgtttacctagaaagtatgtgctaagtaacctgcctaatgccagtcatcactgagagacaccaaaacaaatgattgatagttaactttccattttgctctttgagatcacgtagacagtttatgcagactttactttcctaactcatgtcatcctgtccaaggtactgaacttcacttgccaaggacacacaggaagataaaccctctcaaatgtgctacatttgtcttcaactttttaaatatccatctattttttagattagatgccatctgttgtattatcatatctggttaaatcttattaaaattcctggccaatatatcactctgctgcggcaatcttaccctgctacctctctaggcttttctgcagcattcaataaagagcctgctattttaactaattgctgaggcaggacacagtgtgagagtctaaaacagaatcagcgctatattgtttctacttttacccatagagtgaacaactgttcatatcaaacctggaatcatcccttcaagtctcctaaacacagcacagtttgagccaatgcagttaatccaccctccttcagtgctagtgtcgaatggcgcttttgctgcagtattcaccttgaaactaagtaggcaggattcattatttgttgaagtcacctaactgccagtttattcttatacgatcacaaacaatcacaacagaagacaaatacaggcatatatataactcacttacaagggaagcaaatttgcagccagagacaagggcaacgtaacagccaagaactgcagtaaatctctttgagctaatagccacctctaataatgctctcctacaacacctccaatcaaataaattgtattcagagtttaaatatcaaatcaacattcattccttgatggttacagatgatgtccgataagcaaatttgaatttatgatttatttactccttaagtgtctcaaagccaggattactggaagacttactatgcttattcaagcatgctgacagaactgtaatctcagtaatttctccctgcacctctcagcatgactgacaggcatctgccaagactgtagtacataaactgctgaaacatgcaaaaatatttacccccaaaagatgtagtaaaagctcagcttcctccagcttccataacccctgaagtgttaatctggaggaacagttccatgagtttccacaggccagcagtgtgtctcctacactt

SEQ ID NO: 2 - RNA, 164521 nt, Homo sapiens
auaaauaaaaguugcauuccaugaggagaaaacaaaaaaacccaucacagugaacaauugaauugcuccguggacaucaugccuuucuaagcaagcauugaauauaggagauguauuuaugauaaccagagacagaguauguauagcuuggcuccauaggggugguguucucgguuccuaugucuaccuuuuguauuuuccagcccuucccucauaauguuacugggaaaguuaacagcuagcauaacauuuugaaaacccaaaguguuuauaucaacaagauuauucacagucaaauuuucccauaaauaucacugggaccuauauuucuuuuaauuuuaaccaagagugaagguagugaguauagagcccuggcuuuagaaacuaaccuuuaaaaauaaugagauaaugacacagugaauaaagaugcaucaggguugagcaaaguuauuuuuuaagauuagaaaaacugauuuugaaaaugcaaaggcagacaaaaaggaucagucaagagggaaagaauaaagauagaagagaaguagaacaagucauggagcaagguaucugagaauguagaaaugaaugggaaaaauugaucucugaaaagauauaaaaguauggauugaaggaaggaaggaaggagagggagagaggaaggaagggagagagggaggaagggagaaagggaaagguaggagggggagguaaaguaagaaaaaggaaggaaaaaggaagagaauggaaggaaagaaaaaggaaggaaaaaggaagagaauggaaggaaagaaaaaggaagggaagggaaggaaaagggaagggaaaagggacuuagauauuuuucacuggauaggaaagaaauugaggaaguuuauaaugauguccucuugcuuguugcugaggugaggggcugaguuaucugcaaauaugaggaguguucuaacggaaugauaaaggacucaagcaguugaguaaaaucaauugauauugcaaauuauccacuugugauuuuaagaauuucuuggugaugcaauuuucccaucuauacuugauugucuagaguauuuuccuccucuagugccuuugcugccacacugauuaaaucaauauugauugacaaccucagugggauauuuccaugugccaggaagaauaguacuaucagcaguacccaauucauggugguuuagaaacacauuuauuuucuuauauaauaagaaauuccagugcacacaugaagaauaugcaauuaccagacauauuugcugucuuuagugcgacaaguuuauauaguucgagugucugggcuuugugauacagauauacaaacauacaaacuuaugcaguagaguugucugucccaaugguuacuagacuuuuggauuucaugcaccaguaaaauacaaaugggaggaccgacaccagguugccaauuuuccacuuggcuaaauaaaauauuaaaaccaaugacccauuaucacguauucucaccaucauuuccaaagaacauuuaaacauuaaaugguauuagucuuuagaaaauaaucuaaaagauacaauuucaggauaaaggucuuuaacuuggauauguucagcuuuauaaauauuuauggcauuauucuuaauuuucuggcuuaacuauagacauaugaaaaccuugucauaagggugcugcucuguggagcuguguuuggaauuacuauuuauacccacagugucugguccccagcuuaaacagcaaagugccaccuucuguuauccaaaucagaucuguuuagcaucaaauacuggggucuuaaccacuaugccgcagaucuuuucuaaaauauucuuauuuuaauuaaacagugauuauuaugaagaacaaggaauguaaucauuucugugacuuuucaggaagauuacugcuaggaaaugagaauaguaguuaaaaaaccaguauauauugaauuaauuaccaacaguagaucuaauuuugaagguagaaauuauaaaguccagggcauacaaaauaugauagugugaacacgcagacauaggcacuucaguaacacacagcaaaaaaaaaaaaaaaauccuccccuuucuaaagacacacacacaucuauacuuuuaucuaugucuguuuacauacauacauauauauauaaauguaacucauuuuucuuugaacugauucaagaaugagcugcagacauuguugcauucaccccuaaauacuuuagcaugcauuuucagagaauaagaacauuuucuauuuucauggaacaggcacacuagucuuaacaaaauuaggaaaauuaacacuauuauaauacuaauaacuaauaaacaguccauauucaaauuuauucaacuuucccaauaauauuauuuaucuguuauuuuuuaauuugauauuccauccagaauuguguuuaguugucauaguucuuugaccucauggaauucuuuagccuuucuuugucuuucaugacauugacauuuuuaaggaguucaguccacuuauuuuauagaguguccucaauuugauuuuccuuguaguuagauucugguuuuaaaauuuugacuguguaccaagaaguaauguggcccuuucaguauaucuuaucaggaggcacauaguaucaguuggucucauaauugaugauaucuuugaagguauugucugcuguauuucuccaaaguauacuuucuucuguuuaaauuuucuacuuaauagagaagagauacuuuaagaugcuauaaauacccuauuccucaucaaacuuucacccaugaguuuuaauacucauugaugauucuuguaugaaucaauugucauuagggugauugccaaauagugauuuuucuaacuccguuauuucuucuacaauuguuaauuaacauucaacugcaagaaacagauuuguacuuuuccuuauuuacuuacaucaguauguauuugcugauucuuauucaaugaauuauaaucuuuuacuaucauuuauuuugaugcucaacuugccccagauuuggccagugggaagccccuucuaguugguuccugugucuuacugacaugaccucaucauucuuugaagaauaauuacuuuuuagcacagaaaauaucaugccaaauauuucaaaaugaauauggagauuuauaugauuauguuuuaccaguucuucucuuuguauuuggaaagguaacagugaguaauggcguggauggguaguauaaaaagucugcaggguuuauccuauaauucugaccuaccuuaguuggaaaugggaauuuuuuucagcuacuaauauaucagaauuaauuguuguguugcuuuaggauugugauguuaugaagaggcaaagucaguccauuguacaaggaugggaaaagccuuuuaauuacugucccuuuucugguugaggcuauauucccucuucuggcuucaccugaugacaagggaaggcuucucguuccucagaaauuuagauagauuaauuuagacuguuaauuuuacuaucuggaccacccgaguaaccuuuccaugauaucugugaauucugcacuggacuucacugugguucccccaguuacuguuuuucuuuaucugcaaaaguuagcaagauuaagaccccaagcugaagcaaggcacaucuuugcuuccugcugacuuucaugagcuguugaaucaccuugugucagccaggcaggagacagauggcaugcugaaaugaggcauauagaagaauuucaugaaggggacauuuacaaaagugucagcaauguuaggagaaagcuacaaggaauacaaaagcacucucaaugcagcagcagaccugaaggagcaaggggaggagugauuaccugaccccagagaaaguagcuucaguuguaugaggggcagucugauuggaguaugacuuuucggggaggaaugaguccagugccaacccagcaaagaaggaauuggagaagaaauauuccuaugucaaucuucucucucuggugcuuucccacuggugcuucucauuggccaaaccaauugggagcucaaagguaggagagcccauuuuugcaauguguagaagucacccuucugggacacacagaaugaugcagaagcagagagaguggcucuggaggagcaaacacaguauccuacacacauggcaauucuaaauuuuuaaaugaugauuuaaggguuucuuuucauagcucaaggggucauccaccaucacucuggcuuccauacuucucuuccuccuagaaucacuagcuauccucugacaccaguucuuccuccuaacagagaacacaccugcugcuuguaauucugggaggucauuacccccuaccuccagugacauaucuacccuagguuuuguugucaacguggguaugccucugugugugugugugugugugugugugugugugugugugugcgcgcgcgcuccccuucucccccaauuuguaauguaaaaaaucuccauaucauuagaauauucuguuaacaaaaagugacugggcaaacaauaaaauaaaaaauguaaucuuuauuaguuuugcacauuuuaaauguugguuagcauuauuuagcauaauaguagcauuuuccagcaugcaguucacgaauacaguuuaucuaaguaguuuuaaggaaaagaggagccuaugguuugcuucuguaagaaacacaaaauguccugauguaauugacuauauaaguugacuacucuguuuuuguggaaaaaaaaauuaugaagcccacauucuauuuagaacaaucuagagcagcauuacuccaaagaaaugaaaacauaaaccgaagucagaaaaaaagaacaaaaauaacauaagcacuaccuucaauucaguuagugcagguacuaccagaaauauaaauaaaauuuuaaacccuuuuccaauugcaaagcauaauuuggauaugaaucgugaaccuauuuugcuccuuaaaauugugaaauaaucuaaaauuagcaaauguaauuuaaaaagcagaaaucuacaacuacccagucuuguuuucaugucuuauuuagcaaauuucuuucaugaaaaaguacuauggacagaaaguaagaaaagugauugugauaucaaccugaagauaauuuccucuucauauuuauguacauaaugcugaaaaauaaaauaaagugacuuuuuacaguauuuauauuugcuuauaaaauucuaaacacauauuuaauagguuaagcaguguguuuuuuuaaacaugucuguacagucuggcuauauaccauauguuauccacuuaaaauguaaaaauaaccaaaaagcuguuaaagugcugcaaacuauugcuuaaugacuuaaauaaaugagaucuguugaacaauuuccuugacuuuaccacugacauaugguuucucauaaaugagauucugagcagugagagaaaccagauacagcagcaugguaauauaaacaugcauugauagcauccaaacuaucuauaaaugguacagaauacauuuuauuaccuguguaaagcuugcacucuacauuucuugugguacauauuugaugcaauaaauacugugcuuaggucauuauuuguuugcucaaacgugcaccacaggguaaaaugacuauuuacauaauaaauagcauuucauuaacauauacagugucaaccuugcugagagccgaagauggcuaaacaaagugcaggaaaaagcagaaauuuauaaagaguaauuuuggucaauucagucuucuggcgguggagggugaggggcaauauucacuauucagguuuuuuuuuuaauacaacaaaaagaaacauaacauuuaugacuccaaacauuugaaugaaguuugcaccugcuaagauuuacuggccuacccacaaauaaucuacuuggucuaggggcuggauuucgcaaaacaagaucaacaaagcaccuccacuuaucacccaauuaccccucccagaaauauggugaaauuuaagaauuuguuuuucuugugacuuuuucucaugcaugaucucuaagugcagcaugcccucaugcaaaccacgacuuuguguagcugggagggccaugugguugccauaccccccagguggcauaccuguuauagagguccuuagccuauuucucaacagaaacuucguuuacaaaaauagucacauauaauaaacacauggauuaacaaaaagaugaauccacuaacagauuccauaaaaaugugacaaauguggcaguugaaaugcaaacaguggauacaauuacuacacuaaaguguuucauguuaaacaaccccaaaaucacagguuugcaccccuugaaacuggucccuacagucugacuagccauugugcaucuuaucuucagcagugucagcugguagugagaacaguaaccuccugucaaggucaucuccccuuuacacagagucacaguuugcugacaaggggucacugucuuauuguaggcacugaccuuaaggagauuuguguaaaaacagucaguuuggcauugaccuccuaaaggaguccuguugauaaaaauacaucaccuucacaggcuguaaacaauuugucacccaauuauuuuuauuuauuuucauuuauuucccuuuggcuuuuucaucuuugccuucuugcucauguuuuuccacaauuggcuuugucacccggucauaggaagguggacaagcugcaguggacauggucagaucaguuuuuucuguaauagaguuuucauuuauucugucaauuaucaugucuucuuuuauaagaagauuagccccaccuuugauuuuguuuuuauuguacguaaaggaagcuuguuuuacaguucgcuuuaaaagguggcgucuguaagcacgcugaauaaugacagcagauacuuccucuuguuuucguuuuaaaguaguagugauuggcugauaggagaccuuggaaggauuggaagccaugaaucgcucuuccaucuguauucguagagcauccaucucuccacucucuccuagaacccgcuuuguaaaagcaaauaagauaucaagacaguggauccggucaccacucaccaugggcaaauccauggcaaugagcuggaguuuguuugguuguggcagauugagaggcgguucaagcgcagcugcaaacugagauaauuuuucaaauuccaugaacugaguugcaucgggaucaaacuucucccaaaccucauagaacaucucaaagucauccucacucagaggcucugcacuuucuucaguagcaacacugaaguucuccaggaugaccgcgauguacauguucaccacaaccaggaaggauaugaugauguaacugacaaaaaagaaaauuccaacagauggguucccacagucucccuuaacugagcuuccaggguuaacuuuauuagggucacagucggguggcuuacuguugagaaugggugcuagcaauccaucccagccagcagagguuguaauuuggaauaggcagaucaugcuguugccaaaggucucaaaguugaacaugucaucgaucccaacuucccucuuaacauaggcaaaguuggacaucccaaagauggcguagaugaacaugacuaggaagaguaggaggccgauguuaaacaacgcaggaagggacaucaucaaagcaaagagcagcgugcggauccccuuugcuccuuugaucagacguaggauucggccaauccuagcaagacggaucacucggaacaggguaggggacacgaaauacuuuucuaucagcucggcaagaaacauaccuaugaauaaacaaugagaauaccaaccagugaagaaaucaugcguuaaaauaaacauauguuucuucuaaagcuccaagguaagguucagaguccugaacccaguuauauuaaauaugacaacuauauauaauauauauauaauuguacauaauauauuauaaaucuuaauuuugaaauucagcaauaauuucaauuauaaggauuauaguacuuuuuuuuaucuuuaagagauguuuauaaacuacuuuuaguuuauguaaagucccaagucagaauuuaaaaagaaaauaaguuaaaaaugcacauuuggccgaacaguagcagcccaacaguauagguacaaguuuauauguauacagugacuuuuucugaaauugccauauucuaaauucucuauuuacuccuuuuccaucugaaaguauugguagcuuuugaugcuacuuucaucuccccaugaucuugguacuuacuuaaauuccacucuaauauuuuuauauacucauuuauguauguucuggugcauuucugaaaggaucccagguugaugcucuuuuuaguauccuguacuuaauguuguauuucaauucuuuuuggucuccuguaccuaacacuguaaucucagucuucuuauuuucagcuucucucuccauuugcuuuuuagauaaaaacaauacuuguaaaguuaaaaagaagagcucaagaaacuaaaugccuucaaguuuaaaugccucauucugaaaagacgaaguguaagagugugugugugugugugugugugugugugugagagagagagagagagaaggagacgugugagaauacaacuuuuauaccuuagccacacuaguuauaaccaaggauuauaauuagugggaaucaaaggcuauauacaaugagcuggauauaaggccaguuucuucagagaggggaguggcaugaaaaucuguccaacacaggugccucguuuuggauaguaaaauauugacccaaucauaucauccuguuuagggaagaaugaauaggcccacagacagaugcuuuuuacuuuacuagagcuuuaguuuugucuaaugaaaugagcuauugcucaugaggcuaguuauguguuccaggcuuugaaguauaguacugaugaugucccaugccaccuuauuucccuugugcaucauuaugauaaacccauuuuuaagguagucuagaaaaucucuacaugacacuugcagagaaccuacuauaugcauuugcuaauguuuaguccuugucuuuauucucuuuuuaugcaauacuuuuccuuaucuugaaaccacuuuccacuaauaucuauaugcuggugacuccaugucuauucucuaaagcaauuuucgugaguaccagacuacauuucuagucuuguuaacagaaccaucuagauacuauauugguucuucaaucucaacaugucaaaaacauuuuuauuuuaguuaauagcacaguucuaguucaaaugaaugagguuuuacuacauuuacacuaaguauauuguucuaaauggauagaauaagaaacaauacugacauauaguaggagacauuuuguuaaaaaaacaaacacacuuggauaaaauguaucaaaauauuuacagugauuaucucugauugcugggaugaucuugaaucuaaucuugauuguuucagcuuucacuuuuauuuaacugaauuuaagaacuuuaaauauuucuuaccuacaauggagagaaugacaaccacaaaaucaaaaauauuccauccaaugguaaaauaauaauggcguagagagaugaguuucaguacacacucuccaguaaauagcacaaugaacaccagauugaugcgugacaaaaugguagucacauauucacucuggucaucuguuuccaccaucauugugaccauguuaagacagaugagaaucaugaugcuuaugucaaaaacuugucugguuacgaagucaaagaccauuccuugaaauuuguucuguagagaaauagaaaugcuuuuaacaacaaaggaguuuucucaugugcauuagcauuaaguacuuucugcauuaauugacuuucuaguuucuugcaaaguagucauuggcccugauuuuuguaagaaugauuuauagcauauuaauuguuaaaauuuaguuauuuaaauugccauuuacuaauguguauuucucagaauaacaaucccuuauccaaagaagguuucugauaaaaacaaacaaacaaacaaacaaacaaacaaaagaaacauucaacacuguauacuucuuccagagguaugcaacacauaucaacauuuuaagauuaugaaaagguaagaaacccauuuaauuuuuuuuucaagacuuuccaaugaucagcuggaccauacauccauuuuaaaauauaguacuauuaauauuucacuuguuguauucucaaauaauuguuaaggagaauuuggaauuuccaagacacaucuauaacauuaugcauuuaaauaccacauauggcaauacucauauucuucuaccaaauagccuuggcuaacauugucagacacagaauccugaaacugcacaaggauaaugagaccagaaugacauuuccuauauguuuaugucaaaaaaaacuucacguucuuugucguugaucugugauucugcuucccauuucugccacugcuagucacugaaggccaucugcaggcuuauuucuuugggccacugaggaauucugagggaauuuuccaacuuauauuuuuccuaaauuguuguuucauuucuacucuuagugcuaaauuuuaauggagaaaguauauauuucucaucauucucaggaaggcaauauucaaucaucacaauaugaauauuugcuaguaguuuuuuccuugaugcacccuaggaauuacugaaaccucucagaucaucaucauaaaaauauuuauagugugggauaauagcuguacauuuucauagcaauuuguuuauuucaucauggaagcaugaguauuguuauuuaucaucauaaacuguaauuacugacccugacuucugcagacauuaguaauaccuaacucuauagccauacauaugaauaguagauacuggaauucuuuccuccuuuaaaacacuuaguaucucuagugaaaaauaaaauagaaguaagguguuauuucacucaacacuucauuucuuaaaauauuaggaaauugcauuucuuacagccccaucccaagguuuacuucuuucccugauauuacuuggcaaccauucuugaguugugugauuaacuuucucuugugcacaucacauugucuauguguccauuggccaauuaauauggauuguaauggggugcuucuaaaucucuugaagucaaggguguaucuucuauuucuucuuguucuuuuuuggucuuuaauuuuuuuuguuguuaccauuaucauaaaagauacaaacaucacuuuuagaugaugcucuacaagugaaagaaauuuuuucuacuggaaauguuagcuacuuucuuuuuugugagacaagcaugcaaguuuuuguuuuuguauuuuucccccauaucauuugauacuucuuacuccuggucgagguauaggcuuuugcgguuuuuucgauccuaauuuuuucauugcauuauaguauuucuucuguucuucugucauaaagaugucuugaccuccaaaguauagaaaagaaaaaucaaacugguuaaaacuguguccuuuuguacauuuuuuucaauguuaaaauagaaaauggauggcuaaaaaaagaaauacaaaauucaacugauuaguauaauuauaucugggauuuaaaauguaaaaaaaauuguacucuuuagguaugauaauauuuaauucccuaaauaauucaaaauugacuuuauuauuauuaucuuaugaagacaaacacccccaaaucucaaaaagguuaaguauuuuacccaagaccuuaugcuuagugaguggcgaaauuugguucacugagauaauaaauacuugguaccuuauacuauacauacuaccuuuaugauguuaaaggcaauaauuuucuuauuuaaauguagcaaagaguuagaggauguauacugcaagacaguuuggaguuacucauuaaaaaagucacucuaacucugucaagaauuggaggaaagggauaaaaagaaaacuggaugaguuagugagagauuuaggggauaaaucagagcucauagcauaguaaguaugggacagaccaguagggauagaagauuggaacacuggcaaguaagugaaauagaguagccugauauugacuuaagaauacuacugguaauaagaaaagggaauugaggggagaauguucuguagucuaagaaagcacucauucauuauacaaaaagcaaaccuacugaacaagugagaugaagcaacaguacauaaaggaagaaauacaaauggccaaugagcauuuaagaacauguucaaauguaauaaaauacauaaaagucauaacaauuaagguuauaaaagucauaaaaauuaaaauuaaauacaguuuucaccuauuaaauaucaaauauucaaaaacagaauguuuggugacagugagggaacgguggcauggguguucauacacugauauugggaguuugaguaguuauauuacucuaggggaguaaaauacuucauugugggaauuuauucucaggaaauaauuaaagccuuauuuucugucccucucucuuuuuuuuuguacaaaacuuucaacaagguacuauuuaaaucauuaaagauuaaaaacaaucuaaauuaucaaccuacuggggaaugaauaaguaaauuaugauaaugcauauaugaagacuuaacaaaaugagaaaauacuuauguuaagucuaaaguggaauuuauaauuauagauaaaaaguacaacaauaagaguaugugcagaaauacucugaacagaaaacaaaaugugaauggcagcaguuacuuccaagugaugauauuuauuuacuuuccauauguucuauaauguacauagguaauugggacaaucaaaugagccuuauaaaugauaaauaauagucauacaauucaagacugaaacggauagcuuguauuuaaauaucuuggagaaagaaaugggaauauauaaaagaaaucaaugacagaaaaaagcguaaaaauaaacacuagaagaagcuuacauccagugccuaauuuauugcaaagaauuaguuggaaaauauauuuucaagggggaguggguaguuguagggauaaaguaacaaauugcuuuugggaaagaggcauauucgguugcuuucuaguuuuauucuaauuauuauuuuuuaaaagauagaaaauguuucuugauaaugaauaagaggaggaaaaacuuuaugaaccuaugaacaagaguguggaacacaguuauucuuagcuuucuauagccggaaauauauggauagugaaugacagaggaagaggaaggaaaaaucaguuauaauauauacucccauuuuguuucuaaauucaaguacucauuuggcagagaaaacacuccaaggaauaauuuucuaucucagugggagagaaaauauuagaaauacuuaucuucuuuuucugcugguugaaauuaucuaugaugacaccaauaaacagguucaaggugaagaaggacccaaagaugaugaaaauaacaaaguaaagauacauguacagacuuucuucauacuuaggcuggaguuccaccuaccaaaggggaauauuuuguaaaauauuaccauacauuuuagugcuggaaaugucacuggugcuuuuucauaacaauagaaaaaauuauucuuacuaauaugucagcauuuuuuuuuuuucugaaucaacuaccucuaaaaaacaucccugaaauuggccuuuagggauguuuucaugugaaaaauauggcuauuaugacauucuaaaaucuauuuuuauaacuauaaauacaaauaauauucuuccauuugaacaguaaugugcuaaauuugcaagcuuuuaagguacugaauuuuaguaauuuuaaaauuauuaauaaaaaauuuaaaacuguaaauaucuacaggcuagguuuagaaacagucauucauguaugcaugaaauaauguagcaaauaagaaaugaguuguucauucagauguuuggcacuuuacccuaaaguaacaguuauugaauuuuucagauuaaguagacauagauggacaguccauuuuauaaauccucaguugauuauuuaauuccuagauugugcuuaaaacaaaugggcuauuacuuauaauuuaguaauggacugaaaggucacuauaguuuuuuaacagauucauguccuucuaaaagcaacaaaguuaaaaaccaacuaaacacacaaaacaaaauauaagugacaaagugaaauaaaacaacucuggagguuaucaaaaugauauucaacauaaaacuaaagcuauuugaaaugcacuucaagaaagauaacaucaaacucuaucagguugaagacugcagggacagagguuauucuuuaugaugauaaacuaaacagaugggacuugagaauagaaagaugaagguugauagaaaauacuacaucuuacaaaguuuugaagagcaaaguuggaaugagcaugaauuucaguuuaggucuuggagccugaaagaggcugaaaucaaauaaaauagguuuauauuuuggugauauacacuuaaaggaaucuguuggucacagaagugauugcaacauuaguaaaggcuccagucaauuuaugaaugcaaaaaucauauaaaaacauucuuuuauaugguuuaaaauaggauuauuugaaagaaaucaucacaguaaucuaaggcugacagaacaauauccauaacuuuucaugcugucuaauauggagggugacuauacauuucaacuaaugauagaaaucauauauuucuucaaauuuggucccgcacacuaaaauuacuacuaauuauauaauguguggauaaauaggaaacaaaauagaaaauauuuaaaaggaaaauauuuguuaguuacuaaauacaugaauuuguuacuuugguuuucaaaauaauucauguguugaauuaucuuaguaagaucuuucugauaaacauugcuaugcuugaauauuuaccugucacacuuuuucccaaauauuuuaaaucaagauagaaucauuucauuuggucguuuaugcuuuauucgauuaauuuuaccaccugaucaauauuguaaaaagacuuagaauacaaggaauacuuacauuucuggaaucaacugcugcauacauuauauccauccauccuuugaauguggccuauuaagaaggacaugcauguuuuacuuuggaguaaaaauaauuuagaccugauguuuaauaaauauucuuacugauauaauuuucaaaagggaauauuuuugaaagacauuucaaaacaaauuuuacacagauuuuggaccaagacaguauuuuaguauggcuuuucauuucuagaacacauauugaacaaaauggccauuugauauauccuccccuugauaaccaacucacaagcacuuuucaauucuuuagaguucauggugucaugauauuuaaagcaguauuaaaauuugcuggagcacuuuuuagaaagucuuacaaaugccaacacaugggucaauagcucuaucagccaaauaauuacaacuuagaucuaaggaucaucugcuaaaauuuaucugcagggugaucaaagugauugaaaauuuaagauuucucuuuauuguaacaauguaaggauaguaccaggauacauaaaggcaggguugcaacuauccuuuuaagaauuuuggagcaaaacauuuagaaauacaauccuuuuaagaauuuugcaucaaaacauuuagaaauaacccccuauucuauuuucuuucugaaauucuugaagauaauaaguuaauaugaauaagaaaugugaacaauaguacagcagacacuuggcacucacaggaugaaggauacucaggcuaacaacuuacaguaauuuguuacuuguccuggggcaugaauuuugaguccugugggccuaaaaggauuaucccuuagcuagugagggagguuagcaaagccuuuagcgucuguaucacaauauaucuuuguucugauaacgcuaacccuugugaggugguggauuucaugagacaaaagcuaagcaagggugugggugacagcagugaaaagaaaguaaugauuccuagcuagaaaguacaaggcuuuuguauaugaaagagagagagauguguuaaauaugucaguggcuuaggucaaugauagaacaauuccauuacacacuugguauagaaacaaaaaagugauucaagggaccauuucaaugacuuacuaaucaauagagaggugauucuauaaaagccaaaugugaagcaguauuuuagaggguuuuuuuuuuuuuugguggcagaauuuauuuaauagcuuugugcaggaccaucacuguauuuucagaauugcuuacauuuuaaaggauugcuuaaaauuuuuaauuuuucuuuccucaaauuuauggaggaggugguugcuuuagugauauuuacaaguauggucauuaguuaaggguuagaauaagugcccaaauaaauaucaucaugugucgacaauuuuuaaagaaagcauucuugcuagauuuuuuuuaacuuuuguuuuuauuugucuuuagagacaaggucucacuauguugccuccacuggucuagaucuccuggccucaagcaauccuccagcuuuggccucccaaagagcuaggauuacaggcaugagccaccaugccccacccguucuuaccagauuuaaaaaaucucuauuuuaauugcaugaauauuauucagaguagaucaaaaauguuaagaagagaaauaagaauuuccaacaaaaaggugggaagaauuuguaaaguaaucauaguugacaccucuggaagagcugcaaaaggguuuugaccaguguugguuuguuugcuuaguuagucuucugguugaacaguugaaaucauaaccuuggugagcaaaaauugauuucugcccuaaagacacuguagaaccacaagggaagaaagaaauuguacagucuuuuuuuuuuaagcugaguuuucaaauaaucuggacucuuauuuuauucccugcuuuguuguggugcugcugcagcuagaagcagaaucaaaugaaaauguuuaaagggcuaccuuuuuuaaauauaaauuauaaacuauuuuucuuggagacccagucuuagagacccaguagugaaaacauuaauauuuaggacaaaauagacuuaaauaauggugcugaaaggucauuugagauaagacaacagcugcuuuugcuucauuuuuguuucuaguugcuuccagguauaauucucucucuuuuuuuuuuuuuuuuuuuuuuuuuuuagauggaguuucacucuuuguugcccaggcuggagugcaguggcacccaccgcuaugccugguucuaauucuaaaaccuaaaugucauuccccaaacuuugauccaaauaauagaacucagcagcaguuaaucccuaccaauuaauuacaauccaauuagguguauuaaguguauguguuuuggaagaugaucuaucuguuaaguguauuccguuuugguagcugaucagggaaacaagccuucuaaucacaauaaaaaauggcaaaguuacugauuuauuaauuuacuuguuuauauagaaagagcaauauagaaacaaagaaaauacaagaaaaaagacaaagaggucuuuguuuggucuggucacuacugacuauaucugcaguccuuacauguaauaaaguuuucacccaucugggcucauaaacuuguacuaacaaauugaaauuuuuuaaauagaaagaaauauauacuuuuucuuaggaacuaaauaauagauguaugucauuauuuuguuauuauuccaaacaauaaaaauauucagagaaaauaguguucacuuacaacuugaagcaaagagagauacccaaauccuacauuaucaaaguuuacuuucacauuuuuccaucgagcagucucauuucuuucuauuaguuuuaggcaaucaguaugauuauucacgucuucgaugucaaaccugucaccaguugugguguuaauacagugguagaauuugccagcaaacaaauuuacgcccaugaugcugaaaauuagccagaauauaagacaaaccagaagcacauucaugauggauggaauugcuccuaaaagggcauucacaaccaccuaauacacaaauggaaaaaaagaaaagucagaauucuuaucuguuaauaaagaaaaaaaauuccccuaguaaucucuggucuuuccauucuuuuuuucuaucaaugcuauuuauucuaggauauguaaaagcaagguucaaaaaaaucuuaaaauucauuuuuuuuucuuaagcaauacacuuaggaaaacaacuauaggcaauauaaccaagaaaugaaacaaaaauguuuuuaaaaaaaagggagggagaagcauuaaaagguuaaaggaaaaggaaaaucagaggaacuugcugccagaugaagucagaauuguguuaucagaauaaagaaaaguuaaaaagccuauacagaaguuuaacucauuuuaaaaaggcaauauauuaaagaacaaaacuaaaacauuuggaccugaguugauuugaccaauauauuuuuaaaauaacuuaaaaauucagaugauaaauauaaaaaauauuauuaaauaccuaauauaauugucuuuaauuauucaugcauugcuaugacuaauaauuuuugcauaagaagcaagacaauuugcauuauguauuucauuagaucaucacaucguuuauuucaagcuccagucaugucaguuguuucauuuacugaguuuaauucaaaaaacuuauuucaaaugaaacauaauagaaaucauuucuuaggaaaauaagaaaaagagggaugccauacauaguucucaaaucugaugugaucacaugaaguucuguguucaauuauuaucuacuuuuuuuuuuuucuauagaaggauguuuucccccucuuuacuucuggaccacuaguuaaaaaucuugaguguucauguuuggaaacaacauagggauggcuuccuugcuuuuuccuccauaccucccacuggagcugcacaggaguggcuaagagggaagcuaaaaacagacccuaaaaugcuuauaaggggcagcugccucaaacuuggacauuaauagcuaaguuuaauuccaccuaugugcuuguauuauucuugucagucugauccaauggaaguagucgucaaaacaucuucuauuugccauuugaugccaguguauuuuuagaacaauuuuuuuuaacugccugucugaaaaaaaaauacaugagccaauuucuuauacuucugaucccuguuuaaagccuguaaagaacucuaggccuucuggggaacauaaaacagugugauaagugggccaaagaaaauaagaauaccaguaaugacaaagguggaggggaugaguaugaaaaauuaauuugguugaguuauccaggcagaaccaaaugauguggccgaugcaacuaccaagcugacacgugacacuuugccuuaucucaucugacugucugcauuaauacaauggacuucauaaauucucguuauauaauuuauuuuaaauggaugaauagaauuagauuucuuucagauuagagauuuggaaauugaaaucaaguuacuauuucccuucuuuucugaauauuuuguccacuauccagauuacaaugcuguuucuaguguguauacacagaguacuaauuaaaauacguauuuugccuucaacacccaauuuagaguaugagcagaacacugauuaucuauaccuauuucucgauuuucuuuucacauuaccugucucacauuuuuucuuugaaacguuucucagcuuugccaccucuuuuccauucucacagucaccaccuagaacugcccucuguuauuucauacuugcacugucaucugucuccuaaccuucuccuucauuuaaucuauguaagaugaauuaaucuuccccaagucccacuugaaaguuauuuauuggcucucugguaacuaacaaauauuuuucuuaccuugguauucacaucacuccacaaucuauauuuccaguuuuaacuucccuggucaucuauacuucaugccacuucaauuaauauaauaaccgugugcuaauauaauugccaggugauugagaugccauuuacauugaaauuccuugucuaauagcuccucuucugaaauacucuccccucuuaaaggcuuuaguucaaauagcacuucuuucauggagccuaacuuugucccccaguuuagccuccaaaauaaagaggaauguuuuccccuuugaauucaagaaucagaauucuaguacugaacagaacuguacagauaauucaguauugcguucucauuuggcauaugagaaaaaugagguuaaaacaaguuaaguucagaaaguagccuauaaauagcauuuagugcuguuuccagucuacguggaagaguugcucccacuuaucugguacccauauuacucuguacuagaguucaguguaauccugacagauuguaagauuuucuaaaaauuuaagaugcaaacauauguucgugaaucuuccagggccuugagugucuugaauauaagaacauaccagagagcuuugaauauaggaauaaaauaaugguugacaaaaaugaauggguuaaugaagcaaaguuuagauuaguauuuauugaucaaagcauaauuuuuaaauguuauuucugaauaugggaugagaauaauuaaggaacugagcacagggagaaguuugugcuuagguaauauguuugagagguuuacuuugaaacuggggauugauuuagaguuaaagcgaacucuauggaauuuaugacgcaagcauguacucugcagcagugcacuucaggauaugauuugcaaaguuggcauacauuuggcccagagaaaaguuuuauuuuuuuugugaacauaaaauaacuuuaucuuagaaaacaucuggcacaguauuggggaguuuauuauacaaagcuauagucauauuuaugauguauuaaauuagacaaugaaagaucauagaaaagauugucuuuucccaagaguuccaagccauuccuugguucagcaaagaaggagguguauuaacuuuuuucagucucaauaaagcugcaguaauugguucuuauggggggaagaaaguaggcagaauuagucugaauaaauuggaaagaacaaauuucaaauugaacuuucaggcuacaugaaaggaaaugucugagaaaggagcuaucuuaaugaauuaauacuguacuagagguuguuucuucucagaagcuuuuuuuucaaaacaaucaucaaauaaaguuucucuacucuagcacaaccaauucuauuucugguucauuaccugcauuuuuaaaaauaagucuacacuaaaugaaggauugauaauuaaauaugcaaauucacauuagaaauuuucauacaugcagaaaugucuuuuuaucugaauuaauuacuuugaacuucaaaucaacacuauucaugaauucuagugcuucucuaauagaaauaaagaaaaucuaugugaauaaaaauaaaagugggcaaaguaggaaucauccauuuuuaaguauaaagaagaauaauagaaucuuucuuaaaaaucuaaaaaaauuauguuguggguuuuaauuaagacaguuuuuuuguaagcuaugauauauuggugauccaaacaaaaauucugacuuuuucugucucucgaauauaaacucuucuucuuguauaauacacuuaaacuuuaagaauaaauaaaauguagaguuauguuuauguauguuuucacuguguuauguuuuaaaauccuagaaaguuaguugggaguuacuuauucuaagaagugaguuuaugccuuaaauuuuaucuuaauacucaugauaagacguuuuuguuuuauuucuagguauguauucuauucugcauaauucaaauaaguggauuuuuuuauucuaacuuuuuguuuacaacacaauucacaugugcuuauucaacuauuucuuaauauauuuuugccuuguuaacauuuugaaaauaaccccauaugaacuuacacaauaaaaaaugagaguggucacaaucaauaccagucuuaugaaaccugaaauauugcacccuaguaucugcucauacauaucaauaaucaacugaugguaucuaacugguaauuuucaggacccagaccaauguacuaaacagcaggggcuguaugccucaaacaguaucaugagcuuaacaaguuaaauuguuuuuucacauaaucauucuacaccagggucccccgcccucaccaauccaguaaucuccccaaagauggauaacuccauauacacauaacuaaaucauauucaaugaaacuuaauaaagauaucaaccauugggguuaaaauccacagaggguaaauucauaaagguuuuuuuuuuuuucaaaugaaauuuaagacaauugaaaagaggggauuaggauguaaauaauguauuuucccuacuguggugcaauaauaguacccuucccaaucccucccucaccccacuacacauaagucacagugcaaggauuaaagguagcaaaagggguaauacaguacccauaauaaagggcucaggggaggaaccagcgcuccaccccauccaaguuggagcaagauuauccuauacaaaauagaaauauauaguuuguuauuaguuagaaaucugauaugacagaacauuugguguuacuuuuuguucaugaugcucuccgucuguuucccuauccauuaagacuugaguucuuuugaaaaagaagguauuuaagauuuccuagguuaggaaauuaaaaauacaaauuuaaacacaaauuuuauuuuacccuagauauucacgacaucaauucacucaguuuaauuuuacaaguugaaaaauuuggacuggaaauuugaaauacaauaaauguuuaaaagcugucagccagaaaugugcauaaaacaugcaaaacacaaagugcaacgugaugauaauuuauuuguuacuuucuaacuucuuaucaagcacuguacaacaugcuuuauucaguaauguugcauaaaagcacaugcuuugaaaaaauaacagaacaacaaaaauaaaaugagugccugaguuacgcuuugacgcagcuauugugauuuuaugcugcuagggcaaagaauuaaaugagaguuucugagcauguucaaaucucacuucccaaucauaaucaucauucuuauauccaaccucaccaucauucaugauuauauuuuuacaaaauaaaauauccaaacacuagaaguauaaaaaauagaaucaauuauaacguuauuuugacucuacaaugccaaacacguauugaagagauuagucauuuuagugcuguguguauguugucauuaugaggaauagagccauauucauaaaucugaccauuuaaacuauuaguuauaucacuaucagcauuuauaaggauuuuaugucuaaaacuccaaguuucaaaaacuaaccucuuuuaauauaaaaggcauuauugauuaauaauuauagauaugguuauuucugagaaaauuaaaaguauaccgauaagaucagcuuuuuuauagaaaugaaguguaauguauggaaauaucugagcacuugaccaaugaauuuaauaaacuuucaaauggucaaauguaaaagguuuauaauauuuucaaauguuuagcauuguucagauuucacaagccauauaaaauauauuauuuugauucaggcaacauguuuucaaguagaauguacacaaaugacauuuuuuuucuccagaacugaaacugccagucugaaacaaaacaaagugacauuuaauuggaaaacagacuuaauucuuauacaccccagagauaauuucuguuaacauuuuggugaaaauuugaggcucucugugagaaauaaaagaggacuacuuguauuauauuguucugaguugucgauaaugaggacaaaguuuucauauauguuagggaaaucgaagacaaguccuacguucuuacaaagugacauuuauaauaagacuugagaagagaacauaaggcuauaaacaaucuacaaagugcaaauggaagucuacaauacagcuuaguuuccauaaaaguaacuacaccuuaggaggugaaagagcaguguuuuucuauuggaaucacacaauucaguguuuuguuuugauaauauuuuuuuuuaaaaaaaagcagaacuaauuuuuuauauuauauaucuauaaacuaaugcuucaugccguaaaaaaaggcauggaaaauaagucaauaauggcaaaauuucuaaucuguuaugcaugauggaaaaugauuauugcaucuuugaaaaggauaaaauaacauuuugugugacucugaccaauaagaugcaaguuaagguuaauguauaaauuaccuauaguaaugagucaaaauuauauuuucuguucauuauaaguguuuuacuuuauuguuauaaaaaugauguggauuuguauguaaucuuuaaguuaguauuacuaguuuuauaaauucagucaacacuuaauaucuaaccaucuaaucuugaauauauucaaauaaugcaaacuuuggcauuauacagacaaaaguuuuaacaacuccuuucauuuuuuucuuaacacucauacuuaggcacaugugugauucacauuauuuucaggaaaacucguuaaguacaguauaucaucacaaagaauaaguaccugauauagaauuuacuuuagauuaccauuauaucauuacacauaguacuuuaauaaugcaucagcuuuuuuuuguauauagauuuguaaggaaacucccaagauggauuaggaaauaaagucauuuaaauaagcacagcagauaaaugauauuauaucauuucaagagaggccuauuucucuugcauaucaccuagaaguaaauaugcaacagauaaaacaauaaaguagcaauuuugcaagaauuugccauuccuuuugcaugcauagauuuuccuuuuucuaaauuuaauuuaguuuaauuuuggcuauauacaauacuucagguucuuucauuuuucuuacccucaucccuucaaaucgagauaaggcucuuagaggucucagagcucuuaguguccugagagauuugauggcuccaaguucugaguaacccaaggcauuugcuguuaaacugaccaaugaaaccugcacacacaaaaauaauaacaauuaauaaacagaaucaucauucaauguguaguugcuauauaauacaacaaguauaauuuuugcuuauaauuauucagaggauaaauguucagacauuuucaguaaaccuuuaaaaaauuaaagaaauaauuucaguuugauguaaaggauguaauuuuuaggacauuaauuaaaagcuaguugaaaaaaaauccuuaaaugucauauaauuuaucaacugaauaaauagaaaaaaaaagcaaaguaaaaauuaguaaaauaaaagaagaaaucaagguggaaaaaaauucauuggcuauucuuccuuuauuuuauuaaguugcuguugaauuuaaggcuuuucuuguagcuaguuauaaaauacaaaaacugcuguuguacuaaaaaaagcaggaaguuucuacugugcaucaguauauucaacuaaucauaauugguauucucagaaauuaaugaacuacaucaguuuugaaggugauauuuugucuugguaauaccuugcauuuucacuuguuuauuuuuacauaaguaacuuagaaagaaauuccauuacaaaacuuccucaaaauuuuuuauacuaauuuauggcuucugccaugauaucuggccccaaagggccaaucaaugaauauuuaccaaauacacacagcaauaaauuuacuucauuuguauucauuuguagguaauauacaugacuaaaggaaaaaucuuacguaucuaauucucuaaauaaggaauuuacuaaaacuuuguauucaaggaagauuauaacuuauuugguuagaaagaugcuaguauuggagaauuccgcauauacugcacacuauuuuuguaaacuuuucuuuuuuaaaauguauuaauuguaucauauuuaauauacuucuuacauuauuugagaugugcuguaauuaguccuuuuauagagugcuauacugaucuucauuaaagaauuaaaacagaacauugaaaauaaagauauuauuguuacaaacuacaaaauuuucuauaaaauuauuuucuuaaaauguuucaaaaaugacacuaaaaaacuuucaugaaaaagcugauguguaauaaacauaauagaaaaaaaaccucaggaaguuuuaaaggguuaaauuacauuuagauuuaaauuauaguguaaacaauucugaaauugaaacauaauguaacuucuaaugcuugaaaccucaauauuacaaacuuucucccuuauugaugugauaaagcaauucuuccuuugagauuucucucaauuggcucauuucacaguaacauuguuaaguuuuuuaaauagcuuaguuuugccuuuguucagggucaaggaaauauaaugcauucaugauucuuagcucaagaaacacuuuccacaagaaacccucauagucuugcuggguuaguaucuuuuugggguaaaacuacucaauaugaaaucaggauaguuuugcuguagcuuucuaaagcugaaauuuugccaaguugauaauagaaaacaugaugcuuaacuuuaacacaucuugaagucagucacuuguuuucaguaaaugcaguauuaaucauuggggauacaaauucuauaaagggcuguuugggcuugccguaaaucuaguuuacauucuaggaaaacuuucacugcugaauaaaguagacuucucuuucccuacacucuacauaccuuacuuccuauaaugaagucauaauccauauaaucuacuauuuaaaucuacucuuuaaaaaguuugaguagaucaaauagaauuuuuuuaaaugacuguagcacccaacagcaucacuguuuuuauugagugccuuuaauacuguacaaguugggggucaagaguuuggggccaagaaacuaacucaguggcacaaaaucaacaagugaugguccugggauacaaacuugagucugucugacucacaacauaaaggauuuaagcaacauaccuuuuaaguucccuguuucacuacuuucccuacaaacugcugauguguuguuuuuucuuuagcuuucucagauaacuagagaacuaccauagauuccaucccccaauguuauuuuaaaucagaauuaaauuagcccuugucuuccagaaaugacacucucauugcauauaugcguuuagugguuauuauagucugucaacauaacauaguggucugagacucacuauuguagaauuugaauauaaauaagacaagcuaccuugaacagagacaaaaauaugaacgauaccuacaucaacaauuaagaaguccagccaacaccaggcauuggugaaauauguuugauagccauaugccacccauuuuagaagcauuuccagaaugaaaauguaagugaaaaccuugucagcauauuccaacaucgucuuaaucgucuuucgcugaucaauauauauaucuucaaaugccuauaaagaaaauguuacacauuauuagcuuucaaaaauaauuauacuccauaagcuauuuaaaaaauuaaucauaugcauaugacauuucauuggaauaggagggcagagaaacaguaguuacuguuacuuuuuuuuuuuccucgcaaaggucuuuuacuuauuuaaucaggggaaagacuauugguggaagaaaaagaaaaguaugauuccaaugaauuaauuugacuuagucaggaaauaguucuugauguuguauccugauguggccaucccaacuugaaguuauguauuccuuuuguuucauuuauuuugcuuccuucuauuggcuuuuuuuuuuuuuuuuuuuuuuugcuauagaaaggagguugaagaaauaaugaaagcuugugcuuuuguaaagcagaaauugugauugaucuucgcagucuccaauuugacuaaauaguuggguucaucugcuucuuuuuuguuguuguuuguuauuuuuuuaauaauuuauguuucucaacagacauacagugugacaaugauuaaaugaaauuacuuuucauuuagauucuaauauauauucuucuauuaugaaccucucgauguuucacuucuaaguaugcauuccuuucaacggugaaagacuucuaaaguagcguguagaaaauauuucuuucuucagaaaaauuacagguaaauauaugucuguguuagaauuauaaaaaguuaaacuuguaacacacuugcauuucaaucaggcaaacucuguuucucucucuuucuuucucuuuuucuaucuaugguauuuccuuuguguuaguguuucccuaaaaugcuaucuguauguuuuauuuauaguuuuauaaauaauuuuccuauaaaaauaaauugauucugaugaagugaacaccuuguuauaaagauaaacccauccuuaaaugaaucucuugggcaugcugcccaauauuuauuguuaccaacuuucauuauuucuuaaguagcacaaaaauagugagcacacaauuggaaaaagacagagaaguggucccuaaggacuuacuacuguccaucaagagauaauaauaauaaauaccauuuagaaacaaaauucgucagaacucagagaauauauauucccaucccagggcuuccaauaacuuuuuuuaauuaaacaaugaguaauugaauauucacauccuuugguguuaaugaauaagcugaagggcuacacuuucugggcuauuuaauaguaagcaaaaauuaaugauuagcuucuuaaaauuauauuuacauacauaguaaaaguuaauccagaaauauagaguuauagaguaaaucuauagaagauacaaggugggauaauuaaaaaugcauuggauacuaagacaaugaaacaaaggauuaauaagucaucaguauuagaguguucuaaaaauuagugcuguaucaccuuuucuuaaucucacucaccagagcaccacuacuaaggagaaucaugaaaacaaugaaggucucaaaccaguuauguucaacuauucggaaacacguccuucucagguuccaccauuguuuuccucugccuucuuccacauugauuugacaacacuugaaucuuuguacacagccugcagaaaguguugaaauaaaaguagauaaagugucucugcuuccauaauauccuuuagcaauguccuugucuugucuuuuuauuacuaugcucaucucugucuugcuagcauagcucucuaagccuagaguaguaagagcacauucaucagcugugugaaguuguggaaacauucagccacuuuaaaugaugcccuagcggacaguauuugcuuugucugccucacaguguuauuguccaagagaaacuuuguaaauuacaaauaaaugugagguagcuuuuccuuguaccauaucauccuguugcacucuguugaagucacuccagaaaagaacuuuaaauuggacauuaauaauguuaagcagaaaacuucccuuuuauaaaggauauagaguaaaaauguagaucucuuccaacaaugcugcauuuguuaccauuuaggauuuuuugugaugugccuagaagggcuuauguaauuugcauaauuaauuuaguucacuaaaagcuaauuuguaugauuuggcuuugacuuuucauugccuuccucacacauugcuuucacuuagucuaaaugcaaucaacagguacuucugaguaccauuguaagcacaaaggcacuuagguacacacacaaaaaggcaccgaacauguaccuuacucccaagaaccuuaccaaaaaaaaucugguuuucaaaaaaaaaaaaaagaaaaagauauaaauacaggaucccugcuccaaggcaaaaaaaaaaaaaaggaggaaaagauauguuugaagaaaaaggagaaagggaaugaauggagaaaaggaggaagaaaagaagggaaggaggaaagaaggaacuaaggagugaaggaauggaggaaaagaagagaaaaaagauagaaaaguaacauguaacuguucaaaaagagaaagaguuuucauaggauaauguauauuaucggguaaauuaaauggaaauacuucuuacagccauucagaggaacaagcugcuguuccaccauggucagaugagggcaguuuugaaaaggacauuaagugauaugcaugauuuguauagggaauagaagaagacugaagguauacuaggccuaugaaaaaauaacaucaaauagaaaguaugcauauuuccaaaccucaaauucccagggauaucagaccacaggaaauauuaguuguaggaaaaacauaucucuucuaucuauugcccauacugcaccaggcucaacuagugacuguuuagguauagaguuucuagggcaguauuuauuccccauuucauccaacaauuauuggaaacugauguuuucauuaaagaaacacaauuuagcacuagcaauccguuuaguuuuagcagucagaaaguuacuuuuaaggcaaauucuguguaggaucauuuucaguagugucuaagaugccaacuuauugugaaaucacuacuuacuuuaaaaauauaaguuagaaguuuugaugguacuaaaauauuuuuccuccauguucuuaaucucuuccacauauugggcagauauaaucaaagcaugacacuagacuuuaaguuuuuuugucugucaacauauuagaggugauugaauuauaucuauuacaaagugccauuuuauuauaugugauuuauuuuagcugaccaacagcuaaacaagcugcacuccaaaugaaagauuaacauuaggauucuuuucuuuaccuucagugaaacaagcuucugguucaagaguuucuucagguuccacuacgggcuguucuucuacaggugcgccgauguccacagugcuaccuucugaugagcuacugcuuucauucaguuucuguaagugagauggacauagaaaguaaaguccuuuaauuuugguaauaaguugccugccaagaaaggauuauuacuaugaauuuguuuuuuauucuucuugagguagagauauuuuuagagaaaaagagagauugaauaaggggaagaaauaagaaaaucauugucugugcuaacccuuuuaccauaauucacaauguaagcuugaaaucagauugcuauguuaugagguuacaaaaggccaucagccacauguacugagcaaaacacugccuuguggauuagagaagcaggggacacagggaagagaagagggaggaagagaaagggaaaaggagcaggagagaaagagaaagcuuaccuuagaagaaaauaaugucguuagguuauucugcaguuuaauguuugacuuuacauauuucuuuaacaaugucuuaccuguguguacagauacuaccuguuguuuucacuuauguuacuaagauucaugguuaagguguucagaguuauuuacuauaaauguggucauuuggagagaaauuguuauaaaauaugucaaaaauuacaucaauaaacaaccuuagagauauuaaauagacaucuucaauuucuggcaaguauuuuagagccugaaguguuguaaaaugagauaaauagugugugggaaaauucaguuuccucugacaaaucauguuuauguuaaugugccaugugaagcugaaagaacaaaaucuaguuaaacaacaacaacaauaacaauauccuucauauuuugacaauagugaugggaugcacauuucucuuucuagaguucucagaagacaaagauggcagagauaauagaaaauauuaacuaacauauuaagauaggaaaaacucaugacgcucuuucugaagaccagcaaacuggcuuauaaguuuuuggcaaguguaauuaauucauuaauuuauucaacuaauauuuuuugaacaccaacaauaugcuaccagcugaguauucacugauaacugaaauaucuauuguccuuauuggaguaucaaaucuaguacaguauuuucuaaacuucaggcuuauguagacccgacaauaggcauuccagugcacacagcagcaagccauucaacccguuaucacgauauuguaaauaguaaaaauuaaacacaauauuaaaauuguuaauaugaauuucacauacauaggagaguguugauauuucaguaaaaguuucaccgaaauauuuguauuugcuugaagaaggauagcuuauaugucuggguccauaucuaguugccuucuuuccuuuccuuuuaauuucuuaaaauagaaaaacuuaccugacaguuacagaaaauuaggaccuauaauggcauguagcucugucauagcucugugaauucagguugaagaugaucuuugaaauuauaaaauauuucucacugaagacuaauuucaacauucuaacacauuaaauaggccugcauacuaugcucagaagcugaaaaguugauuguucaacaugauagacaguaguaaauagaucauaaucuacuuucggguugcauuuagcuuugacuaucuuuguguucuguucuagcauuugcacugaauuuaaaacauauccaggaauaagucauugguuucuuccucugacaaacgaagagaaucaccuaguggcaggcguuagucacauucucaaucaaacuacucauaacaucacaugaucuucugaagaaauucuuaugucuuauccucaacauuacacagauucaucauuuggccguaaagugauaggcuaagacuugucacuucaacaagugccuucauauuuuaaaaaugaccuugauuggcacuauccgggacauaaugaaauucauuacauacuuuauaaaaaccaugugagcaacauuucaucacccauuguucuucacuguagaaaagcaaaugcccauucuucaugaaacaauuagagaguggaauuugagaauuuuaacaauuuucgccaaaauuaauuaagaacuagaaaggauauuauuuccugugaauaaauuuguguggagaggcauucagguacaaagaauuauaauagcaaaccuaccuucuauauauauaauuguuaucugcuaggucugauccccacauaguuuuccagucuauaccaagacucacaaaauaauagaauauuagcauaaaaaucuacucuucaucaguauagguugucaguaauaagcagaacaaaaaguugcucaguaauuaaucuucauguaagugccacagauaaaugauugauucuuugcacauaaguguuuuauccaauuguaaggugaauuagauccuggcaugaacauguacauaaaaauuguucuuccuugauuacuaguaauaucaugcaauuguuauugcaugauauuaaaguauacugauacacugauaauaaaguauugccaauaacuaguuuugcuuuuuugccaaccauauuuguuuucuuaugaggaauacuacuuuuaaugauaccucugaagcauugauuuuuauucugccuuuaagugaaaccacuuauucacuuuaugaauuaaagcauuguuuuuuacuuuuucuaagacaaagacuuaucugacuuaccuaaguugugacuauuuucugugaaaauuacgagaacccaaaagaccuuauguuacuuuuugacacauuuucaaaauggcauucucugaagaagacaaauagaucaacaguucaauaaguuuuaauauucagauauucaucuuauauuucuuauuuagacauuuauuuuuaggaugcuuaccuaagauggucacucuuacagaauuacuuuuuaaaaauacauguagauuuaugguucuucugauguuuuuucauuagagucucaauucacaaaaaaaccugaguuuuaaguuuauaugauuuccauuccuauuuuaucccuuugaguuacucaaccaagauaguguaaugaugauguaacacaauaugagaauaacaucaaaauggaaaauugaacaauauaagaguuggcaugcaauuggacauacacgaacucuacccugucuacuaaauguuaggaaaguaaaacuuacuacuaauuuuaaguacaugagcaagcgcuuguaaguacccauauuacauugguaacucuugaagaauguaguggauauuaauaacauaagauuguaugaacuguaugauuguaugaacauuacaagauaauaugaacucuaaauuaucuuauauuuaaaauauguuaaauguuucugaauaacuuugcuauuucaugaggacuacuuuauaaacaaacugggaccaugggugggcuguagauccaggaauuggugaauaguguuacuucuccaaauuguaaaacauuaauggcaaagccaaagauagucacaauggauggauacaauauacuucuaagugugcuuucuuuuuuuaaugcauagagcuuggagucacuccauauuucagaaauuuuaaggugauuuaaaagaugaucaaaugcccuuauuagcauuccaauggaauaucugcacuuggaaaguucgcaggucuagacaagugaucuucuacauguuuacaaauuaauuuuaaaacauuuuuuaagcaauauaaguauauucuacagucugucugaacuacuguaggaaaguggaggugugccuaauaauacucaaauuuaguaugcucucaaucuaaguaaugacuuuuuaaacaaucuuaaacauacuucuuuaaccaaauuccugauucugcaauaucacucuuucagcacccagacucaaauuuuuuuguuuacuuuuacuuauuucaaacauuggcaguaaucaaaagucaguuuuccuuauuuuaucucugaaauaacuauuuucucagucagauuccaaauuccuaugaaauuucuguuuauucuuguuaccuuuucuuuguuuaacuauaaauaaaaauggccauccucauucuagccucaugugacuuagaccuuugugguccacaaagcuuaguguauguauggugaaugacuaacaaacauuuggugaaugaaugaauagaugaauaccucuguuucagauauuagugauggaugaaguuuuuguuuucaacuuagaguuccaaccaaaucucccaaauuugucuuucacagauagaagcuguauguuaaucaaggugaacuucuuuuuuuuuuuuuuuugagacagagucucgcucugucguccacgcuggagugcaguggcgcgaucucggcucacugcaagcuccgccucccaggcucaugccauucuccugccucagccucccaaguagcugggacuacaggcgcccgccaccaugcccggcuaauuuuuuguauuuuuaguagagacaggguuucaccauguuagccaggagggucucgaucuccugaucuugugauccacccgucucggccucccaaagugcugggauuacaggcgugauccaccacgcccggcccaaggugaacuucuuaauguucucugacuuuuucuccuagugauuuuuccucccaucauugcggaagaguaauaauugcucucuuauuuaaaccccuuucaacacuuuacagggacuacuuugggcauauauuuuauuauaacuucucuucauucuaauggacuuacuuacaaaauuaaugacacuugcaguuuucucaguaaaauacaauaacugaugaccuugaugugcaaaaauugcucaggucguuggcuacugccuaggauaucugcacauuucuauuuucaccagcugaaugguaugcuuaucaagaauaaguuauguuuauuuucaaaucaauuuacacuauucuaaaauacuguaaguguguaauuuaaucuuguagaauuugaaaaaugcauuuaaaaaguguuguuguauuuauaaaaacuaagucaaaaucauugaauaaacguaacaccgguaaaucccccacauagauacauguacauuaaaaaaccauaaaauuaggugugaauauuuacuuuuuaaauaguuacaaauauaaauuucugagaagauacuaaauucagguugcuuuauaugauucguuaagauauuuguccucugggggaaaaaaaaaacuaaacagaaauaauagaugaugaauuacaagugcagcucaugcuaaaacauugauguagcacuccaaacaaugaacccaugcuggaacaaggcaccuaaagugacauuuuuauacaugucauuuuuauuuuguaaauaaauggagcaguugaauguuugggauccagagaaguguauacaucuuucaggaacaauauaugauuaaaaauuagauuuaaaaaaugguauucauauuuggcuuaagcucuacuucgcaagucagcauuuugcaaagggaggcugguaagccacaucauggcuaacccuuaugauagacccugauucucauaauaguaagaagaauuuuccccuacuuucaaaucauaauaacaucagaaaaagugacaugugacuauuagaaagauuaaaccauaagcaguggggcuuaugucaaugaauuacucuagauaaacuaugauaaccugagagaaguguuagugcuuuuucuagaaauuuauauauaauguaaauaaaugagcauuaguguaagaaaggaaagaaaaacaaacaaaauaaaauaaguucacaagugaccgaacuaaacuguuuuuagccaaaacauggggaacaacaagaguuuugauuggcauguuaaauaaggaauacaauacagaaauuaaaauuaaauuaaacaaauaguaaaccuuuuacauagucaauagauuaaaauaaauaaaaacauuaauauaaaagucacccagaccuucucaaagaugauaguaaguuuauaaaaacaagaaaggcauuaagcuuaaacacauaauuuguauaaauuauuucuaaaaugcuauaugcuuagucuuuaauguacuuuagaacuuagagaaagucuaucaucugcagaucauaaguuguacagcuaaauuucaaucaacaauuauaccaacauucaguauguauguugcaaugaaaggcaucuguccuacuaauaugacagaagagguguuuccagccaauguucuccagagaucucacuccagccuuaaguggcugaaggcuuuaauucaagcagggaaguuccacuuucaucuaauuuaugcaugauacaugaaaaaauuugauuaaaauauuauuuaaaagauuggaaaacucccuauagucccagcuacuugagaagcugaggcaggagaauugcuugaacuuauaaguuugggaacaauuucagcauuauagcuggaucccauuucuaaaauaaauaaauacauaaaugaaaauuuaaaaaauuuugaaaauguauuggaaaaccauaauugaaucaaaauuuggggaaaugcaugcccaaauuuaagaagaugauguuaaaugaaagaaaaaauauguguggugaauauaggggaaauuauguggaauuuaguaucaugaauuucaguggaaaaaaggugauaaaaugaaaaaaaucuucaagauuuagcaauuucagaugaaacaacuuggcacuaagcuaaugcaaagagcuauuauuuuaaaaaggcucuuaaaguuuagaauuugucaccaacaccacuaguaacuagguggggggcgggguaauaccaagugaagagacaguaucuuuguggguauuaaaaaaguuauuucagggguuuaaucuauaaacuugaagaauugacaguauguugaaugacauguaagaaucucuucuuuaugucugcaaacaugcuuucuucaugacagucuguaguaagcagaauucuaagauggucuccaaaauuucuggccacuguugucaugcccuuguauaauccccugcccuuauguaugggcaggaccugugacuugcuucuaaccaauacaauguggcaaaaguaaugggaugucacucuggugaucaugucacaccgaaucauuuuagaaaaguuacaauguuuucuuuuuucuucaagaaauaaauaauuaguaguucugacuuuuuaauguuaaguaccaacaaccaggcuuacagaagcagcaaaaugugaaagcuuugcuacgugaaaacauauacuaccaaucagguaaacuugacaaauuauacucagguuuuuuacuagaagcugagaggaguuggaauugaacaugaccucagaaaacugcaauauucagauugguaaaguagaccuggauaguauaauugauuuggcaaaaagcacacaauagguuaaaaaaaaacaaacuaggaugcaaaauucucaacuuuaaagcucuuuuuaaauucaacauggugccucuaugaauauuuuauagcuauaccucauuacaauaaguaugcauauuggucauuuuauuugcauauaugcagaauauguguauacauuaucaugugguaaaaugauccauauauggaguaaguagaugauguaaauuacuuuauacagccaaaccacaucugucacucaccauuucugaauugacuauuccaagaacuuuuaaaacaaguuauggccuccaguggagccaacaaccuuauuuuuucacccuucuccuggcccaggccacaguaguggaaagaaagccaccaacaauaaacuggaaagaaacccagaccugguuugaccucuuacuuucugcguggcuuugcucaaauaauucuuccuuuagcccauuuuuuaaauauguaaaaugaagagaugaucuuuaaaguuccagcuuuaauuuucuaugacuuuguaguguuugagaauuugaaaugauacauuuggacagucuuaaauccaagagagauaugaagugaggacugaugagaaggugaugagggagcagaucuggacucaggaggagaaaaggaugaggaaguucagaguggguauggcugcugggccugcacagucuggguaacauguugggacuguggcuaaaaaaguccugugaucagucuggucaacauagugagauccugcugucccuacuaaaaaaaagaaaaaaaaaugauguuuuuuuuuuugauacggaguuucgcucuuguugcccaggcuggagugcaauggcgcaaucucggcucacugugaccucugccucccgggcucaagcgauuccccugccucagccucccaaguagcugggauuacaggcaccugccaccaugccuggcuaauuauuuauauuuuuaguagagacaggguuucaccauguuggccaggcuggucuugaacuccugaccucaggugauccaccuaccucagccucccaaagugcugggauuacagugugagacaccgcgccuggccaaaaauuuuuuuaaauagcuggaugugguggugcaugcuacuuuggaggcugaggugggaggacggcuugagcccaggagguugaggcugcagugagcugugguugcgccacugcacucuggcguggaugaccgagugaggcccugucucaaaaaacaaacaaacaaacaaacaaauaaauaaaugaaaaauccugugaucaucucugaccaaggagaagcaaauagcuauucccaccuuagagacaaagaaaccauccacauguagcugggcuuuuaauuucacuauuagcuguauaugaaauauucaauuacucaacauuuauugaaagauaccauguucugagauuuguguuaaguaucugucucauggaucuccuucaucagcauaaugcauuauuuaccuggguuuuuguuuuguuuuccuuuucauguuuugcuuuuguuucuucuuuuuuauuggccaaauugaaaagcagaaauuacacuaccauuguuuugauauuaacuuauuugauaacaauuaggaguaauauuucuuaagguuugucuuccaguuauauuuuuuaugacuugucucuuuugacuauuauuuguuuguuuauuugagacaggucucauucugucacccaggcuggagugcagugaugaagucacagcucacugcagccucuaccucccagguucaagcaauucugccucagccucccaaguaacugggacuacaggugcaugccaccacacccggcuaauuuuuguauuuuuuguagagacagcaucugauccucaggcuggucuugaacuccggagcucaagcaauucacccaccuuggccucccaaagugcugugacuacaggagugagccacggugcuuggucuuuugccuauuuuucuauuggaguauuaguguucuuauuugauugcaauugcucuuuacacauagaaaaucauuugaguuuuccuaacaaggauuauuugccaaauguauuuguuuucugugucuguguaacaaaugagcauacacccagcaucuuaacauacauucaccaacucacaguuucuguaggucggaagucuggcacugccuaguuggauucucugcucagggucucauugagaugaugucaagguguuggcuggaaauccaguucuuuuccagggcucaggaucuucuuccaaguuuacugucguuggcagaguucauuucucauaauuauaagacugggcuuccuacuuuccugccagcucauggcccagaaccacucucagcaacuagaggccacccauagucucuggccacauggcugcuguaugcaauuuacaauauggguguuugcuuuuuucuaggccaggcagagcauaucuuuucagcuuccucuaugugauagcaggagaaaucacugugcauuuaaagaguuugccugauuaggucaggcccacccagcaucaucccccuuuuugucauaaauguaauguaauuaaagggugauaccauauccacagguuccaaccacacucauggaguggggauuauacaagggcaagugucauugagaucaucuuagaauucugccugauacaccaaaguuugugugucuuacugauuuuuuuuuccuaagaaccauaaccuguuauaccaauauugucugcuacauugauaauucacuauuuuuucucuuuauguauaucuucuuccuuuuuuguuccuuuucuaauuucucaaagauauuuguuagguucuuucaucccuucuuaaucauauuaguaauauuaagucauauuaaugacuacuuggucuucuuccacaaauuuugacauaaaaugcuuuuauuuuugaaauagcuauuuugguauuuuauuaugcuuuuauucaauauuuguuuaggaggcaauuucuuaauuuucaaaugguuggaauucuuucuaucaauuuauuauuaauuucaggcuuaacuacauugugacuggauaacccuauaugccagcuauuuuaaauuuauugagcuuuacuuugaacuccaguauaugguuacuuuuauagaaauauuccaugaacccuugaaaauaaaaauuuucuguaaauauguuuuuugagauaauauacagucauauuuacuuuugcuauuaauauuauccaaaaucuaaauguugucaucuauuuuuuaaaauauuuuaccauaggcuaaaaaaguuguauuaaaaccuucauaaccaguauauuugcaucaauauauucuuauaacgguugagauaaaagaugaagugguccaauucuuuauuugauugggauaauaacacuauuauuauuaaauacucaaaaagggaaggaaaagcuccucuucagauguguaggaaaaguccaccucuauguuagcacaugaaauacgaauucauauaaaauucuaaagaaauucaauaacggcaaaacuaaaauauucucaaauaaguauuuuuacagauuuaaaaaucaguaaggccaauuaauuuuuccuuuuuuguucuuagauugaaauuuaauuucauuuugaaauuugcuauucacuaauaaaguaauuuguucucacuguuuuagagauuaauggaauauuucucuuucuuucuuucuuuuuuuuuuuuuuuuuuuuuugagacugagucuugcucugucgcucaggcuggagugcaguggcgugaucucggcucacugcaagcuccgccucccagguucaugucauucuccugucucagccucccaaguagcugggacuacaggugcccaccacugcacccggcuaauuuuuuguauuuuuaguagagaugggguuucaccguguuagccaggguggucucgaucuccugaccucgugauucgcccgccucggccucccggaauauuucuuaaaaucuauuuuaauguuuauuaaaccaugaaucaaccuuaaauuuuaccaauuucuaaauaggcuaguuuauuuaagaauauguauauuuucacacaugaaucuuaauagcuaaauuauacacuuauacacugacuuguaucauccauguauuuuuggcaggcugacuuaauaugugagcugacagaaugcagagaccacguuguauaugaagcauccacuuugccuuguacaccagggcauucaauaaccacuuaauaacuacaacccugaugguaagagcaguuuuccuccgcaguggauuuaugcaaauuucuuguuuuuuaacaaugcucuuuacuauagcaaaugauuuugaccuugaggguaaggcaaaacaaagcaaggcaaagaaaacuuucuucaauauucucugagaguaagugauuaaaugcuuuuuuucuuguucucugacuugauccuacaauguuuauauuuuuauuuuuaaacuugguuuguuauaaggagcuuauuuauagaguuuaguaggaguucaaauuauaauaaguaauauaaauaaaucuggaauuuaagggucaaaagcauacuuaauauguggucaugcgaugucuauauauuuguauauguauauauguguguacauauauauuuaauauauauauuuaacauacacauguauauauuuaacauauaaagaauauuauccaaaguacuuauuuuuaaagcuggacagguacuauuuuaaugcuggguacuuuacuauugugacacauauaucuccuaagucaugcuaaaaugagguucucuacaaccucagaaaugcuaguauuaauauuucauuguguacauugugcacuaguaaauauuucuauuguacacuaugcauauuaaaaauuaaaaugaccccuauuaaagacucucaacaaaggaaaauauaauaucaauggaaaagacacuguaaugagacucaacauuuccacagggcagcuagaaaacucaaauauuaacucauuaauucccacauuauucccaguugauuucuucaucaagcuguauguugaaaggacaaucuucagugauuauucauauuuacagaaugucaguuguuucuauucuuuagucaaacacuugcccaguauaaaagugaacguggaggaauacggcucuaauauacuacucugaauuuugcuuucgauaggucacacauaaacuucuguaucaauaauuaaauauaagggaacaaaagcaacauauuucagacauauugagucaauagaaaaucaugguaauacaaaaaaauuggaaagaaaacaaaaaaauucugaaaaauugcauuuauaauccccaagcuagaaaccaaaaugcaaaucaaaugaguaauuuucauuguuaaauucauuuugccaaauugagcacagagcuucuauaauguuauuuugacauugauuuuuaauguuaaauuauaacauacuuaauaagugucuacugggcaaauaaacuguauaucuauauaaugaaagaguugaaaguacuacuguucagaggaucagagaaacuugaguuugaaucacaaucacugguuuuauggacuuuaaccaauuauucugaccuccuuaggcuuuagguuucuaauuuguaaaaugguucuuacuucacauccuuguuauaaggacugaacaagauaacacaugaauaacguuuggcguaugcuuauuugauaaaugguaacaauuuccaucacaguauuguauuguuuguaauagguguaauuauugauauuugaacuuuuucacuaccaaaaaugugccaggcaucaaaacuaggacuugaaaaauaaaauagugaacauaauagacuuaguaucugcccucgucgguucacaaucagauggaggauacagagaagcaauugccacacacucuaauaggaguaguauagaguauauugagaacaccaccuagcucaaucuaggaaggacaggguagaauaaagugacauuugggacaagaaggauguggugggugaggaugagucaggugaagcaggauagaguaagagaguauuccugucagagagaaaagguauaacgaugagaacugauaaagcauagggaauuacauugaaugaaagauuaguauagcuggguggggaggugugagguguacuauuccaugauacugaaggagucagcgguggucaguuuugcagggacuuguacccauguuaaguaguauagacuccauacugugagcaaugggcaacuccugaaagguuagggaggacagaacgguuacgggauuugcauuuuagaaagaccaccuauuguuuugucaagacuacacuagcgagaggagacccguuuggaggcuguagcaguaaaacuggaagaugauggaggucugacacuggguaaaggccuugggaaugcagagagguggacaaagauagguagcuuuggcagucccuagugaucaauuagaaguaguggagauaguacucuuggguuccauggauaguacucuucgcagagaguaguugccaucucuuagagacuaugugcuuagguuggagauugucguauguuccuuaacccauauaacguaagauaaaaguauuagauggaaaaauaucagcaaagcaacaaguagauuuaaaaugcauauauaucagugauauaauugggaaaaaauggaaaucuagaaguaacugcccaucaccuauuuauucauucauuuaauaaauauguuguaugugcuguggacuuaagggaagacaggguuaguguuuuuccuguucucaaagaccucauaagcuaaugauacaucauagaaguucuuccuaaugauuuggaagacucuuccagcagcuuuaaacucagaaggggaugcuccuuaagcacaacuaucacacucugggagacuaagugcucucuaaguagaauuagaccaccacaggucagugugggaugcagaagcagaucagccuaaagugcaggccaguaccagaggaacaggaccuuucaggacuaagcaggaggacucugaaacacuccagacuaugcuguuaaccuaugcccaaugugcagugauuggaaguuaacaccaaaucuauaguugacaccuguaccuaguucuucaacaaauaguauuauuuauuucagaacuaugccaaagaaaguacauuuucagacacuauuaagauuuaguguagcgguuaagagcgugacucuggagcagacuauggagcagacugccaggaccaaccacuuacuguuuguguaacuuuggcaaguuuuccuuuguucaaaauauguuuauuuuucucaucuuaaggcuggaauaacagugugucuuacggcauaaagacugaaugggacaauauaugcccuccaauaguacuuuguccauggugaacauuuaaacaauagcuguuauuaacauaaccugaauuacuaaggaccucacauuuuuacucauuauucuagagcucacucaucgcaaaaacaaauguauuucuuuuauaauuacuuuaguaaugugccuuuuuuguucccaaaagguacaacuuuaauaacucaauuuauuuaaaauuuuuauuuaaauggaauuaaguaguaauuuucuugacaucaccuuacacuuuugaacauuuuuaacuuccaaauagcuuuuagaucuucauaacauuucuauaagcaucauaggacagauaucucauuuaauaaauuaggaaacgggguaauauagauuuagcgauuugcucauaguagaguuaaggcuuauaagcucuuaaucuaguauccauauaaaucaaccaaaccucaaaaaauuauugggcaacuguuaugcacccagcauugugguaggugcuucggaggauagaaauguuauaaaauacuauccaaaaccaaaauaaauuuacuuucuauuuggggagauaagauuuuauauugucuuuugcauagucuuggcaguuuugcccagccuucaaagcucucucagaucuguccaagucaccauucuuuauuauuaauguucaauaaaaauucauguuucuagcuuaucauuauuccuacuauggcaugagucaagaaauuuucugagguuuuaaaaaacaauuccucaaauuacuugaauguacuuugaagguugaagucucuuaggacuuaaagagaggaugaaaugugacucaugcuauucccuuucuucuuuuggagaccaauaggaggaagguguagaaaaaacagcccuuaguuugcucuggaauggaggauaguuaggugugaguucaccacagauguaagaggcaaaauaaauaugagguuccaguucaccacaucucuucauaccagucuauucuugcuuccuggaaaccaagacucuuuaccuacaucucauccucagcuccugugauuuacgcccccggaauuccaaacuacuaauugucuccaaauacauccucuugcuuccugucuuuagguuucugcauguuuguauuuccugauuggaaugccccuuagaaaaguaauuuucuuaaauauuuuaaggagcuuaccauaucaagaauguaaucaaaacaauuuaaaaauaaacagaaaauauaaaauguaucaccauccccagauaaacuuauaaaacaauuuauuacagagggcaaaaggcaaacaacaaaaaaagacaaauaguggaguauguuaccaguaguaauucuuguaagaaaacuuacuggaacaguguggaaugcaacugguaacaauaauaaugaugauuuaccagauauucuauauuaauuaggcacugugcuaaguacuucacauuuauuaucucauuuaauacucugucccagaaaugcagucaguaacauuaugcacauuuuugagaugaggaaacugauuauuagauagguaaagucacacaguaagcggcuaaaaugaaauuauauaacccaguaucuggcuccagaguauaaccauuuaccaacuuuauaacuguggccucacaugucuaaaaacaaauauuuaguguaugaagaauaaacagugggcacuuguaauuuuaacacaaggcauuaauauaauuuuggagguauuauaaugaugcauuguagauaagucauuacuggaauucaggaauggaaacaauaacauguucaaaugaaacuagucuaauagaggccaugaaagguaacauuuuugcaucaguaacauaugucucaauaugaaaauucauacuuaaagguugaaagucauacacacacacacacacacacacacacacacacagagacagagagagaaaaucauuccuuauagcuuauuaguauacuccuuuaucuagucucccuggcauaugauaacugauaaauaaaugaaaauaggcaaaaagaauaaaggcuaaaacaaaaagaaccaaaaugaugagauuaauauacuacaggcagcauuccuaauguagaacaaagacucuucaucuauuggggcaucugcugucagcuuaauuccucuaaaagcagaauaucucauaauuuaugccuuacuuugaugaacagaauacaguauaagacugaugaagcaaugagggcaaacaauauuguguggguuuauuucugaccaagaagaaaggaauugugaaguaaaagugccaggaaauuugauacaaugugguaaucugugaaagaauauaaaaagaaagccagauucaaaaaugaauaaaagaaauugaaauguaucauuaggggauaaauagaaguuucaguauuuaauuacaaaauuucgucuggaugagauacaacugcauuucaacagcaauucauguggaaaagaugagagauuauuacuuucuuagaagggugguguaaagugacaagguaacauggcuaacaaaaacaaaaacaacaaaaucuaacucaagugaaucuugaaucuagagaaaaaauugguccaaaauaauuggaauuaaaaugacaaucucaaguaugcucuaaucagagaaaguauuuaugagagcccuucagaaugguuuuauuaagaagaguugaaugagcuggaaaaguuugaucugagugucuacuuuguaccaaacauguuuaaguaggucaccacauaaaaggagagacaugcaugcauauaaguagcuacccuaaaauaugauaguacuuuguaagacgcaugagucaagaagaugcauuauuuauuacuauacucuaugccuuauaucucugggaaccaaaaaagaaagcaaucuguucugccuaggguuaggaaggcuucauuaucacuaccuucaaaaagcugaaacagucuuucugaagcuuaagaacuccuggacuucagacacuaugcccaugaaccaagugguugcauucuaauuagacaaacaaaacauuaaaguucagcacagguggcaaaagcuucauuuaccaggacuucucccucugacaugaaaugugcucuaacguuauucuguucuauuucauuggccgggugcaguagcucacaccuguaaucccagcacuuugggaggcugaggugggcggaucacuauuucauuaaaauuaaaaaaaaaaacuggccuauuaaagggauuucucaagucuaacuaaacuaugacucacaauuugagaagcaccacauuaaauuaucucuaaaguuucuauuaccuuaacauuuaaaauuucaauuaaugcaauguuccaagauauaaaauaccacaaaguagaaagaaacagaacuaccucuagugcuucaguggauaguugcuuuauaaaaagguuaguguuucuuuuagccuugaucaauauaaaaaaacaauaagaguaagaaucaugucaaauuuuuacagaaaauguauaucuuauggauggucuuuguaaaauagucuuuuuccuuuuuaauauaacagauagcauaugguagccauuaguccucaucaaaugcuaaauguaggucuaaagauucaagacaaaggaagcuagacuaggcuauuacuaaauuuauuuuaacagaaguucagaaacaauuuuauaaagacaacaauuuuucaaaaaauuagccuucaucugauuccuuaggaaaacucaaauaaacaaagucugaacugacauaauauccaaauuaaaauuucuguaaaaaaguccacaauauuugauaaaaacagucuauuuuuuuuuuguccugaaucuauuuccauagacauggaaaugugacaggaucuaucuacuauuacaucucugcacuauauuucuuucccuucucucaucaaacaaaucugaauuaacuaagcagcucuaaugcuagggucagggcagcugcuuccagcuccaauauuagcccccuacuccuaaaaguggaggcugaccuagauuauucagagacucauuauaaauacuugaagcaucuuuuaagggauauagucacuaaaucaaaagaaugucacauaccugugguaucuuccauggacaacuaucaaaaugcaauggacaugaugauaucuaauagaauuguaucucuaauaaaaugucuuuaauguauucaauccuuuaaaauauuuagacuauacagccuaaaagaugggcacccugcuguuuuugagauuuccaaacacuaaaugggaaguaaaggugcuuuguccuagacuccuuguuaauuaucuuauauauccauuagacuuuuaacuuaauauuucaaaguagguugcuauggauuaaaguuuugucuccacaaaauucauaugcugaagcucuaaccuucaauaugacuguauuuggggauagggccuguaagguggugauaaagguuaaaugaggucauacagguuggacuuuauucugauagggcuggugcacuuauaagaagaagaauagacaccagaguucucucucuuuccauguacaugcauugaggacaggccaugugaggacgcagcaaggagguggcugucugcaacccaaggagugagcccucacuagacauugaugcugcugguaucuugaucuuggacuuuccaguuucuggacuaugagaaaauaaauuuugguuguuuaagccacccaguuaugguauaguguuauggcaguccaaacaggcuaaugcauagggcaguguaauuuuaguugaaggagcuacaagaauauuucuuguuguuaaguucucuucaauguacaugagccaaugugaugcaaaaaacaauaaacagaacuuguaaacaagggcucuaaguucaacucucggcacuccccucacuagcuaugugaccuaaugcucccuaagcuaauuuucuuaucugaaaaguuaacauaauaacacauuucuuuccagguuauuguaaggauuaaaucugaugauguuugucuauuuguuagaucguucauucauucaucuaacaaauauccauuacuaaggaugagaaaacucacacguauacuauauuacccuuuaauuuaucagucauuuccgaguuaaaucuuuuguuccucagugaaauaaaauuuuacaugaugucaaaaaaaucuauauggaaaauauauaauaauaaauacaggcaauauaaugcauguauuguaaauguuccucaauuuacaaugagguuaguuccugauaaacucauugugaguugaaaauauuguacaucaaaacuuacuuaauacaccuaacuaccaaacuuuauagcuuacccuagucuacuuuaaacaugcucaggaaauguagauuagccuacaguugggcaaaaucaucuaaaggaaagcaugauuuauaauaaacuguuggauaacucagguaauuuccugaauacaguacacuguacgguaaauauugguuguuuauccuuguaaucacgugguugacugggagcugcagcuugcugccccugcccagcaugagaguauauuguaccacaaauugcuagccugggaaaagaucaaaauucaaaauuuagagcaugguuucuagugaauggcuauugcuuuuguauuaucauaaaguaaaaaaaaaaaaaaaucuuaagucaaaacaucauuaagcugaggaucaucuguauguguguauauguauauauguauauguauucauaccuucccacaccuauagaaucuuaccucuuugcuuucuuccagauccgauucacuacuaaagucuuccguguuuaaauuuucaaagucagauucuccuacagcaauugguacagucacaguaagacugggguuguuuaugaaugacauguaaucacuuucaucaauaauguauuuuucaacacugcugccaguuccuauaccacuuguaguuccauuuacaucuuuaagauagucaagaucuuucccaauuucugcuguaugauuggacauacaacugucuuucuuguuguuuagaucaucaagugguuuaauuucaucuaaaaucuuuuguuuccuaaugaaggacuguugaauaaauucauauauuuuucuuuucacauaagcuacuccuuugugcauccuauccacagcaauuuggagauuauucauuucauuaucaucaucaguggcugcaagguugucugcacuaaaugagcucagaagcaaggccagaaagagauucaggaccuuaaaaacaacaaaaacaugauuauaauuuuacaccaauguagggaagagcagauuacaaucacuuauucuuucuuuuaaguguggaaaaaacucuaaguucuaaaacuugaugagaaggaaacaccacagcauagugauuagaagaugggugaucugaauuugugacuggcucaauagcacauccuuggacaaagacaugauuucuguugcucucaaguucucccauucguaaagugaaauugaaugagcuaaucuaagguuuuguuaacucuaaaauuguaugaguagaagaaaacagauuuauauguguacaauacgagaauucuuaaaaaucacuaauguuuccaaguaugcauuuaaaugcauucuauaauuuuucaauaaacaaagauauuaaauuggaugucaauugaaaaauaaccauuacaacucagaaugaagauuaggagcuuaacauaggcugacacuuguuuucuuaaucuauuauauuucucauacuucauuguugacuaaguagagcuguuuaugaauaaucucucauauuuccaugagacuggcacaugaauguacauaccuuuagaauauuuuauguauuacuauacuauaaacaguaacacuccaaauuuaagagagauaaagauugaucaguuacuccauuaugguaaucucaggcaucauuagccauucgagaacugaugaacucagguuggcuagugcaucugccauaugacauagagugauugaauaucauaugcugcaauggggcaaagaaauggcacaagcauuaugaacucuuaaagacaccacuuuuuaguccuagucuggaugguaauuuugcacuuucucucuacuuuuuuuagacuucucucuuccuuggcucugaauuuauaaaauggucccagcacauccuuuuaggcucaucucaauaugauacucuauuguaauucacauaaaaaaugugauaaagugacugacaaaauagaauuugguauaaaaaaugcaggggcacugcuauauugcuguguuguuaaagugauaauauauccaagguaauggacuuuuaaaccaauaaucauaguuuguuuuucuuuuugacaaaacagucaccauuaaauuauacucuuuuuuuuuauuauacuuuaaguuuuaggguacaugugcacaaugugcagguuaguuacauauguauacaugugccaugcugguguauuuccaaaaugcauaucuuaaguggguacauaccacuagguuuccaaucaccaugaccaucaugaagacaguaaggcacauggcuugaccagcaaccuccauacagucccacauggucucuauccacuccccacacagcacgcggaacacaaucaggaaggaguggaagaagucauucaugugccagcgugggaguugacaaucacuggcgaucuugcagacacaaucuuuguagcuuuuaccaaagagcugcaugccgaccacggcaaaaaugaagacgaugauggccaagacgaggguuaaauuucccagagcccccacggaauugccgaugaucuuuauuagcauauuuaacguuggccaagauuuugccaacuugaaaacucgcagcuggaaaaugaaagauuaauauauauuuguaugauucuuaaaagcauuauauauauugagcuuuaccuagaaauggucauuagaauucaauaucuuacaauaucugaucugcccuaaccgucucaggcucauggcuaauuuuuggacucccuaggaaaagcuggauuuuccauauuuuaaccauguagaucauuuucucugauggugaauuauuuuucuuuccuuuucuuuuuuuuuuucuuuugucacccaggcgggagugcagaggagugaucucggcucacugcaaccucugccucccagguuaaagugauccuccugccccagccucccaaguagcugggacuacaggcacgugccaccacaccugguuaaauauauauauaguagagacggaguuucaccauguuggccaggcuggucacgaacuccugaccucaagugauccaacugccucagucucccaaagugcuaggauuacaggcaugagccaccaagccaggccucuuauagugaauuuuuaaugaguacuuggaauccaacuguucuuaauuuguuuuauaaaggugguucuaaggccggauauuauaauauuaacaucugaaucugaaauaucucugcugaaagauauuaauuugccaguagugugcaaaguaacaucauacugagcccugauauaaguaaaguguucauuauucauuaaugcuccuuagggguauucauguaguuacauccaccugcauugaaaaacuuggaauauuuccuauaauucuacaauuauuuuccugacuuguaaggauauaugugugaauuaaugggcaugcuuaguaauccuacagacuuucucuccuuugacuuucgcaagaugcauauuuuccagagacagaauuagaaaaaguuucugcaugcacaucuuacaucugauuuucauccacugcuacaaagggcuauauauauuuucaaguuacuauuaaaaggugaugcauuuucauuaaaaauauuuucuuaggucuagaaauauuaacuguaguagucucuagaagcaauacuuagugaaaauagcaacugaguaauacguuaacuuuuacguaacuauguucuuugaaauaaagguuuucauaaauaauugagaauuuuuuuccauguaggaaaaguuuuugacaaugcaaauguuacagaaaaacuuacaaugcuaaugguuguguggcaaaaaaacuaugacauugcuaugcaagaacccugauuguuagaaagguuuuugaauuuggugcuuuuuuuuuuuuuuuuuaccaaucgaaaugaacggagaacagauaauccuuccacauuggcgaguccaaguucuaccaggcuaagcgucacaauaaaaccgucaaagauauuccagccuucuuggaaauaauaguaaggauccauggcaauaauuuucagaaacauuucugcuguaaagaucccagugaaaaccuaagaucaaaacaaaauuaaucuaauuccaccagauaauaacauacaugacauaagauuugcucuuagaacauaaugcuuaugcuauuuucccacaaugauucuauuacuaacuuaaauuuguauggcaauuuguaguugaugaaagacuuucauauacauuauuuaauuuuauccuuguggaaacgcgaaguagauaauauacaauuauuacuuuacagauaaggaaacugaggucuucagaugggugaaauggcuugcuugauaucauacagcaagaaaauggcaaaacuaggauuugaguacaagucaucuuuuuuuuuuuuuuuuuuuuuuuuuuuuuuuugagacggagugucagucugucgcccaggcuggaguguaguggugccaucuuggcucacugcaagcuccuggguucacgccauucuccugccucagccucccgaguagcugggacuacaggcgcccgccaccacgcccgccuaauuuuuuguauuuuuaguagagacgggguuucaccauguuaggcaggauggucucgaucuccugaccucgugauccguccgccucggccucccaaagugcugggauuacaggcgugagccacugcgcccagcccaagucaucuauuuuuaacagugcucuuuccauuauaccaaacuaccuuuuuguccagacuuuauauaccacaaguacugacaacauuuugcccaugagcacuuuuauuuaucuauaagcuuauuccuauuucccucaaucagaguuauacauucuuaucuauuauacuaggugcauuacuauugucauucuuuguuaugcacaugaaaaaaauaaauuuacuucuguaguauaaauaguagaacuucaaaaauauaacuaauaaaaugcagguuguuaugcaugaugcuuuuguuuucuaccaucaaaaauccuaaacuucaaaccaaauauuacaggaaaugcauaaauuacuuuagauagcucuuuccuucagcaaauaaaagcuaguauuccuaaguugaguugacuggcaaacacuuuaauaauuuauguuuuugaagcacaaaaaggaaaaauuaaguggcaaucuucaccaaaaaugaccuuuguaaucauauaacacacaaaauguacuggaaguuuucaauaguucaugguuuugauauagaauagauggauaaacaauacauguacuacuuagauccuggaagaggaaaagcuggagacauuuuugaguuguuaaauuauuucuugcagugaugaugacuaagaaggauaaaagagauccacaauuuuauuuuaaucuucuacaguaagggaaauuguaauaauaucucaaaaaguauguucuuaaucuaugagcuacuucuggauccugaaaaauuauaaauauugcuguugacuuuucaaguagugcuguaggccuaugccuuucucaguuuuugugagcacauuaagggugauuauuuuuggcaaaaaaguagaguauagccagcuaaauauaauugcgauuuugcaggggccaggaagcaugaaggaugguugaaagacugcuauacacaauuaaauguaaacaguuuuucaagcagaaaauuugaagacuaaacacauuuaccuuccaauaugcuuaccaaguuuccuacuguaagcacauuauugaaaugguccgucauuggauagugcuccauggccaugaaaagaguauuuaagacaauacagauggugauggccaggucaacaaauggguccaucacaaccagguugacaacauguuucacuuuuaaccaauauggagaacagucccagauuaagaauauguuggaaaauuuauaccaacagggugggcauuucugccuggauucuucaaguucuagauuaagaaaaaaaaaaaaaagaaccaccaaaagguauacuuuauacacacacauuuauuucauauccacuaaacuuauuuucaguaaucaacacauuuuuguuacagagacaaccuuuuuuguacuuguuaaaaaaauuacaguuuacucuaaaccucccaaggauauuucaucagacacacacauagagcccagguaacaauggguaguuuuuugucuuaugcacugacauuguggcucagcacuuggccucaaguuaaaugaguggucuuucaugugacgucucaaugggaacaugguuuagggugguguagauauugugugugcaacccuaugugaaugacucuacauugucaaccucagacuaugagagcuagaauagggauugaugugacccaagaaucaucuuuuuagcuuguuuuuauuuugugaaaaugaccugcucuuccucuacaaucuugagaguacuuaggaugaggcugaaaagggcuguacugcugaagucuuaaacuaauggaacaaaaagagggucacuaugacuaaugagauuagaaaccccuaacagaaaugcuuuguucugcauuuucaaagaguugcuacacaguuaggaaaacauucuuagucccaauaucacucauuuuaaaauaaauuguuaaggcuucuagaauaucugaguagauauaagaaauaacagcucuugaauuagacugucuuuucauuagaaugcacuauucccaacucacaaauauauuuguuugaaaugagacaauauaaguuuggugaaaauaauugaaacgaaaauagaauuuguuaccaaccuucuacuguauuuguuagaaugcuggcuauacucauugcucguugccuuugggaaggaucuucuagaaaguccauggaaacguggaaagaacuugaccuucucuuucucauuucaguuucagugguuguucccuguaaaaaaaaaugcuaaugcauuaaacaauuaauuugagcaauaugacaagcaaacaaccaaauggugacacagugaauuucaugaaacacaugcaucaugcacuuucauauucaauuggugauggcagauauuucugacuuauuguaucauuagccuggaauguucaaacuguuaaccauuuagucauacagcaaaaaccaagauguuaacuuccugauuucauaauuuuauaaaauacaaaauaauuuuaauauaguugauaaaacucuuaagagauauauuuaacaguuauuacccuuauuucugaacuaauaguaaaagccuaguaacuuaaaaguccuacaagugaucaaggcacuugauuuuugagaagguagcuauuuaauuuuaaggaaguauaaaugauugcaacacacuuagcugccaucuuauuuucuggacacaagauguagauggucauugacaacacaaacucuauguuaaaaagaacacacacaugcugcauggacaacaguuucauccaggguaccaaagcaauaagucaucuaauucugacuuagucaugccuccucaugcugauauauuuccaagugaguaaacagucuaagaagaggcagcaucuguuuagaaauuccucaucugaguauacauccacaaacacauaacauaccuuuguacacagacaauuauuuuaucugucuguauuaauaauguauuugugucucuucauuuaauuuugagaagaccuauaucagcauuuuuuaguaagaaaaauaugaguacuaggaguauuaagguaacaaugaagcuaucuacuuaagcaguguuuuugaaaaucuaaacuaaagcagagaucuugaagaauccauuggaaagauuuauuacauacccuugacacuuaaacauagaaucauucauuuacuuucauaccagagccuuggagaauguccugcuaucuaaauucaguguggguauauagcaaauccuccaacuggaggcaguaauuauugugucuaaucaauccuuagcacuuuuaauaaguaaaugcauucagguuugugcaggagacugcuaagguuuuaaguuuuaguugguuagucuauuaaagauauuacaagaugcaggugcauucacagcgugaccaaccaggaaucauucucaagguugccguucuguagaaacacuggcuggugcagcaauagugagccagccaugccugaacuauuuaaaacuuccuuacauugucaucaguagcuggcuuaucuauuaucaccucuggcagaagcuguccaacaggcgauguaggaacugaagguccaccaaccaaggaaaccacaccauugcaauccacagugcugugcaucuucccauucgcuggaaacacugccagcauccgggaugaccuacuggucugacucagguugcuguugcgucucucuccgugucgucggggcacaaacaaggaaucucuacggcucucguuauccucaaaggugcugugcucaucaucugcgaagucguucucagaucccacauccuuugcucgcccucuaaagcugaaaaggcuuguucugcuauuucgccuuggugaaaauagggagccacggaugcucaacaaagacuagaaguuugaaagagcaaacaaauaaagucauauuaauauggacauuugaaugugauuucauuuugcaagauuauguagaaggagauuucagcauucauaacagaauaugguucauuccuuuugauuaucauucucauuuuaugugcauucacauuaaauuaaauuaccuugauaaaagaaaguuucuagcccuugggauuaaagaaugaggagauagauugcaaccuuaacauauugaaacacacacacacacacauacacacacacccugaacgaccauuucucaaguucaaagggaaacauccuuagaauauggcaauggacgugguaaacauucagugaacacuggcaccaugaccuuaacaaggccaccuugguuuuuauggaucuugucuuucaaaaacuuucaacacuccucacaauuuacuuuaguccaccuuucuaaaaucacuuuaauuauuauuucuuuuucaccuauaaggcauuguauuguuggaacuugaaguucauacuucugaaauucagagucaugugccuuuugaucaaguguaccaugacuaauauuuucagaagcaugcauggugacuuauaaagaaguuagggggaaaaaaaacauaaaaucauaaaauaaccuaaggacauuccugaucgacuauccggaguuccacauuuuuuuuuuucuuaaaagugcugaggaucaaaaagauuaaaugucauuaguuauagacaaauaucagcagacaguaucagaaugacaguccaguucuccugacugucaacuugguguuaucuuaacuacaccgagcuguagacuuacauaucuguggaguaaaguuuuugcauaacuaugugaagaagggauggguuuaaauauaacacaacagugguugauucaguugauaaaaauuccugaguccauuuucuaauucucccccucucucccauguuuuaauuuucaaccaugcaucaguaaacucagcagugccauaccugguguggggaggaguaccucuuuucauaugucaaucgguucccuucaauggagaagcgaaaaccuuuccuccugaugcuguccucagauucagauuuuuggaauucauccucaucuuucucuuccccaccagacugcucuuucuguuuucuuuucuuccuccgauuucuucuuuccuuagcacucuuggaacucaacuuagaggcuucagaugagcugucugagagccugccugcugcacugggcucucuggaauguucugaggcaguugccguugcugccugcuauauugaagagaaaugauuuuaacauagcaccugaagagacuguaucuuucuuugaaagggcugaaguauuugcauggcuuuuaaaaaauauauugaacugacugaagaucaucucacagagaagauucucugcaaguauaagaggagauuuuuuuuuucuuucuaccuaaugaaggcuuuuggagauaauuuaguuugcuccaugguaacauuuauuaugucucuguuaaugcuccacagaccacguauucaaaaauauccaacauguaucaacaagaaaauaaauucauuacuuuuugggauuugauuuacuuuaaaaauugguauuuaauuaguguuguuuucuuuucuccgaaaaagaaacucgaguauggaagaaaagcugaugaguuuaaggcaggggaaugggauaaggaccugagguccuuucucuaguuauugaaauuggauuguccaauacccucaaaauauuauuaauccuauuuauggacaguuauaaaaucccuuucucacccauccacaauauccagaagaauggggaagggagaaucaauaguuucugcugagcaagauaagacauccaguucuccaaaaacuguccccaccaucuucaaaucaguacugguucuuaaggggcacaugggcauggaauaaaacaaugcuuuuugauuauagcuuguacugguacuaaguugacacuuuuuuauuauuaucauuguucccaggguaaccucgauaaauuaauuacucuugcauauaaauuaauauuucugaaacaacuuucuucuuuaguaaagacaauaaguuuguaugcuaaacagaaagaugagagagauaggagaggcauuuuaugauuuaucacacugugaggacuaacacuucacuauaaaaacaaguaauccuuuuuagauggucaaucuguguaagauugguaacauucauaugucuauuggaugcugcuguaucagagaucauuauauuauuugaucacuuccuuauaaagguaauaaagcaaccacguuaaaagccaacauauuuuuaguuaaagaaaaaaggagacuauguuuaagaacuagaggagcaacucuucauaugauaaccaauaauuucuuguucuaagaaaagaugauuuccuccuaaugccagucuacucauugaauaaaagucucucacuugaaaauaccccaaaauaacauuuucccuuuacuuugagaaucuuaagaugauuaaaauagcaugagagaguucuauugugguuauuauuauacacaucucaaauaaaauaauuaaacuaaauaaaaguaaguggaucaucaaaauauagaaaucauuauuaauuccucauacaaccaccugcucuuagguacucacuuucucuucaauauuacguaacaaucagaacgauaaaaggucagugccaugagacagggcagcuuuaccugagcugccuccuguugcuuuuuaagcuguucaaucaucugcugaaauucggccucuuucuguucugcuucuuccaagguggccugauucuguuccucguaggccauggccaccacagccaggaucaaauuuauuagguagaaugagcccaagaaaaugaccaauacaaaaaauaucauguacguuuucccagcagcacguaaugucugcaaacaaaaauaucagaauuauuucucaauauuauuucacuaagugguggcuucaacuuucaauuuacucaugugucuagcaaaacucagauauaaauaguaauuauguuggucauagcacccuguacuuuuuuuuuauuguuucuuuaacuucagcuucuuccuucucuucuagcuuaugcauucacacuaugauuucuauggcagaauuuuuguauucaccaagaaugaaacagucaauaaaaugccauggaguccuccauuaacgaccugagccuuuaggaaagucaaggaacagaccaaaguuaucuuucuauaucugcuuuuucauuuucauuacuucccaccugagggauaauauuugaggggguagauagggcugaagggagaaugugccuucuguuuaggacaaucugugucugagaaggguagggaacagguuuugagccaagaagaaaugggagagaauugcaauccuuggcaucacucugcucaguauguguuauaaucaauaggauagaggaacucaagucucguuucaaguucugcucuuucuacuauauuaucauccgguuuuaauuucauaacucaauugguuuucuuguauacuuuuacuuaaauggagaguguggcucuuuaguucucaccaguugauaaagauuuucccagaaguccugagucauuagucgaaacaaggacaaaaaagcccaacugaagguaucaaagcuuguguagccauaauugggauuucuaccagcuuucacacacauauaucccucuggacauuggcugcaagugggguaaaagaaaguauuacaagucguucugcugccuuuuuacucugauacuaugcuaugauauugccuagucagaaagauuugguauuucaaaauaaaaguuugacaaauaaguaacuaaucuauuucccaacuuuugacugcauauagucuuauuagcuacuuggugucaucauuaaaauauggugcagcauuucuaauaauauuuuacaaaauaauuuuuguugauaauuugcauuuucaacaccuccauuucauuuuuacuacuauggagucuccagaguuuauagcucaauauacuuaucuaaaagaacaacauuguuauuauuauauacuccuaaaaaaguaggaacaggauuacuccucuuuuuguauguuugcuguuauauacaguagguguuuaauagauauuuuucucuuuuuuuauacuuuuauuugaaguucagggguacguacauguacagguuuguuauauagguaaaugugugucaugaggguuuguuguguagauuauuucaucacugagguauuaagccuaguacccacuaguuauuuuuccugauccucucccucuucccaccuugcacacucugguaggcccuaguguguguuguucccuauauguguccauguguucucaucauuuagcucccacuuauaagugaggacaugcgguacuuaguuuucuguuccugcaauaguuugcuaaggauaauagccuccaguucuauccauaucccugcaaaggacaugaucuaguuauuuuuuauggcugcauaguaucccaugauguauauguaccacauuuucuuuauccagccuaucauugauggacauuuagguugauuccaugucuuugcuauugugaauagugcugcaaugaacauacgugugcaugugucuaaaaguauuacuucuuguuuuagaaaacauaaaucuuaccuaauauuuacauaaucucauacuuuaucaaaaaccuuacauauagcaaauuaaugucaauaaaauuaguuggcuguuaucuucaguuucuauaaaaagagagaaaagauacacauauguauguguacauacaaauauacacagauacacacaaauuauugacuuacccugcaucagagcuauuuccacauaguagugcaucuaaaaaacccuccaggaaauaaugauauccuguuugaaaaaagaaagucguaugaugaacauuugcauuguuaaaaacacucaaaugagaacaggaaggucagguucuacuuuuaaguuuauugaguaauuuuaaauauauuauucauucaaaggcacaaguauuugucucuucucccucuaaauucuagauauucuauuagauacuuuacagugcaaaguauuucuucauuaugaagaaaugacauuagauuagauacagugcaaagauacuuuagacacuuuacagugcaaaguauuucuucauuaugaauguaaaguuagugauaaugacagguacuaacauaaucuuucaaaaagguauuagcauuuguucaccauucucacgaaaaaaauucauucaguaaaaauagacaggaaugacaggaauuucuuuguuuuugcaaaacagccacauauuucaaaauaaaagaauaguauauuuucugguccucucgccuauauuuuuaacacuauacauuuuaauaauuaaguauaacauauucucacauuuugcagaauauaggcaacuuauaguaaaauaugcauaaaucauaucaacaacugaaaugaaagcaauuuuaaaaagucuuaaauacuaaagcuaaaauaaugacuauaggugaacacuacauuaucucaaagauuccuguuucuugcaaacuccuuggcuucuugcaauguccaguucuucuauaacuuuuuccuugguauuuucaacuuucuuucuacuaaauauugacauaauuaagaacuccccucacugugcuaccaguaaccuguauauacuugaauuauucuuaggaugacacuacuauauuguaauuauuuauuuacaaauauuccuccuagaaagucccaaucauuaauuauuucuauauuaguguuuguuugagaccggguagccuuucuguaaaguuuauugaaugaauaaguaaauaaaagacaaaaagagaaaaacauggaauuaaacaaucaauguuggauuuuguaagaagauauauuuucuagaugcuaaguuuucugaggaauuuauuccauacauaguucuguacaggacacagaagcacauaaggaaaaauaucauuuuuauuucuaauauucugacuuccuugaaccuagacaggaaaguugacauaguauuuccuaacuuucaauuaaaauuaaacaaagagaaaggacuauaauaguuucuggaugaauuuuugauaucucauauuuauaaaugaaguuuugcccauuaaauucaaugaucuaaccuuaaugaucagccuuaaccugaggaaaauauaauuuuucaguuauaauaguuaccuuuaauuuuaauaaauuuaauuuucuauuauuuucagaaaugaaccauuuuauuuauauuugcauuugguuuaaaauaagaaccauagauguuuagagcugaaaaugaccucagauauuauuuuacuucgaguauuggaaaaaugcaguccaauaaauuuucccuagagagaauaaacccuaaauaacccucauagucaguauuuugaacuuagauaaaacaaacaaacaacagauuucagggagcuggugauugaaguggaccuacuggcauucguaucaccagcuacuaaggaggcugagaugggaagaugccaccacacccaacucauuaaaaaaaguauauauauauauauauauauauauguguguauauauuuuuuuuuuguagagaaggggucucacuauguugcccacacuggucucaaacuccuggccucaagugauccuccagccucagccucccaaagugcuaggauuauaggugugagccacugcacccaacuaacauuuucuauuacugucuccugaagcuuuauuaacuguaauuuucuucuuuuuaauguaauacuacuuuuuaaauauaagaauaagauuuacuuuuagguaucacuuuauuuccuuaagguaauaaaauaaucuauuaaacuauaacacucugaagccaugcauuaccuccauuauuuuccccaguguacuauacaguuucugauacauuaaagacauuguguaauuaauguauaaugaguuacauuugcauaguauuguagaauucgcaaagggcauucacauauuuuaucuccuuucauuauaucaaucaccacaggaagaauguauagcaaccaaggauccuaggaaaauucuuucuagcugaauucuucagccuuccaaaugaugauaaaauagaaaguggcauuuaggagucaaaacuagaguaguuaugaacaaaguuguuaaauguauguggaagccauugauaaggugauuaacaaaauucuucuuuuaguuccagaaauauaaauaaucuauuauuuaaaauccaggggguagaaauaccaaauaaaauauaauuuuaaauauuguuaaauaguuugauuagguaauuuucuaaaagaucacgucuuguuauguaaucauuuaaaaauauuuuucauuccuagauggaaggcacauuagcaaugaaaagaccaaauauacaugauaguaauucuuuuuuagaggguguuuuauuuauuucauuaguuuuaaauuuuaaauuuuaauuuuuguggguacaugguagguguuucuauauaugggguacaugagauguuuugauacaggccugcaaugugugcuaaucacaucauguaaaaugggauauccagccccucaaguauuuauccuuuguguuacaaacaauccaauucuacuuuuuaaggaaauguacauaacaauaauucuuacuugaaucuugaauauaugacuuccagucaaacucaaagacaguuucauuuauaaguguaccauuauaauucacaguuauauucuuuucuauacuauguuccuccaaggaagcauuggugggaggccauuguauacauuuauuccucagguugcccaugaacagcugcagcccaauuagagcaaauacgcucagacagaacacagucaggaucauuacaucugagagcuucuucacagacuggaucagggcucccacaaugguuuucaggccugaaagaaagaagucuauuacuaugaagacuuaacacgugugaaauaauaaaagcuucacacaauuuucuugaaaacauagauuucauucauaaauccaagaauguuugcaacgcuaguggagaagcaacacuucauugaaggggaagaacuuaugaagauaaacuccagaaauguaaugauuuaaacaaugaaaugaagauucauaucccauuaugucgagauagaguaauggaagguucauguucuucauggagccuauauuaaggaaagggccuugucuuuuuccuuuuugcuacugaaacuugucucauauuuucauuagggucagaggucaguuuuauaacaaaauaccugaauaaauauuuuaaaauuccuauuuauaaguaggaaagauuuugcuguacaaccgaaaauggucugcaguauaauugugccuuaagauaauaaauccuccaugcagacucacacuauucuuuauugucuuauucccuucucuuuuguuagcaaaaaacuuagaagauuugcauuguauacacauagucauuaaugacucuaaugaauaagaaauuacagauugguacauuuaaaagggagcaaauucucgauaaaacuaacauggugaaaaaaaaaaaaacccaugauauuuguaagugcaggucaccuugaccucaaauuacaguaucucacauaagacauuguuaaacuccaaggcugauaaagcuuaugucuaaacaauaagaaucauuuucuuugaaacaccuagucuuaugauuccugauuuucuguaaaacugaaugucaagcagagaaggaugcugaaucacaugauggguccgucucauuaucuaaccuugcucucaccuggaaugacugaaaucgucuucaaugcucggagaacucugaauguucucaaugccgagacauugcccagguccacaaacucugugacguaccuguaauagggaguucacacacaaacacaaaaacaggacacaaagaaaaagcuguagguacaaagagccuauccuuuacucuaaucacuucuuaccuggaauuaccgaaauaguuuucaaagcucucaagacucugaaagugcgaagagcugaaaaauugccuagguuuacaaauucuguuacaaaccuguagaauuaaaucagaauuauucaagauuuuagcaggauuuauauuacuugcaugggucuuuuauaaagaccuucuuggugauuuuaaaugauaaauauuauaagugguaaaucaggaauuagauuccaucauuaaucuuuguucacauaauuuaaggccauuagcuaaauguaaacuucauaaaguagacacccuuguugucacucuggaaagcaaugcaaccaacaucauguguaacuuguaaaaagaaaguaaaucuuggcuaugguuuaggguuuuaguuagaaaaaaauauaugaaaucacccaacagaaauuuaggcaugaaaaggcaguuugccuuacugcuuuuauauaugagauaagauuuuccuaguguaacuuuuaaauaaaaguuaagcaaauuaagaacaauacuugaugaggguccaaugcugcgccuauuguuacugccauuuuguucuuaagaaauagaaguccuguaggccuucuuuugagcugugaccagagagccuagcaaagaauuggcucauccugaucagauaggaaauuaagaccagacauucggaguccugaguguaucagugccaccucuccugcuccuauccacuacaucacaacuguuagaggccaaaaaaucagcuccugaaggaaggaugaggguaaguguuguugggcugccuccuucuacacucuacuuucacuuagucuggaaugguuuucuauuauuuuucugggucucuuccugaggaaguuugccacuagaaaaaaaagcauuggggugcauaaacugugcauauuacugaguggauaugaauaggagauaaggauaaggaaguuuauguucagacuaaagagaugaagagagccauaaaaggaaagaagaaaagaagaaagaaaaggggucaggagagaaacagaaagaggcagagagaauguauuccucuacaggucuuagaaaucaguaauuuaauauauuaaaaacauaauauuucaaguaucuucuuucuucucuuaguuugauuugucagaucguuuugaugcuaguagauacuuacuuucaauuauuuuaccaaaccaauaaaagaagcuguguguaauaucagcaaggucauugcaaauuuguguagccaauagaacuguuuuguggcuguaauuuuuaaaguuauuuucacagauguauuacaaauaugcuuguguuuugacauuagauuguguguguucauauguguguguguuugugcauguguguguggaagaguggcauaugugaaauuuucugacugaugcuacgugugaaaauuguaguuuucaacuacugcaaagccuucaugcuauagugaaauuccacuuagaccuuuguugugcuaaauugaaauccagaguuugaauguauaaaucacaccaaaauauucuacagguaaagcaaaccuauucuuaaaagcauaagcacugauggaaaaccaaacuauguucucucuuaaaguuucaaaaaaggcacuuacgcaaauguaaugacagugaaaucgagccaguuccauggaucccgaaggaaaguaaaaucuucuaaacagaauccccuugcaauaauuuuuauaagugauucaaaaguauauauuccugugaagguguaucugaaaacaagcauccaaaaaauuugauaaaguaacaguguuuuuucauagcauaccaauuucuuaucacuccaucaguggaauagauaaauacuaaaaaagaaaacuaagcagauggauuuuaauuucauacaaaugaaacguagcccuaaauuuaaauucagcuuccuaacacaaagaguuguuucguaaagugucuuaagaguagugugagaaauacaagguauaugaaaucuauuuagccauugucugaaaugucuugguauuuauguaaauauagucuccugagaaauauuuaguauguuuacaugauggaauagccaaucaauaauauugcagaagcaugaaaugauuuucuuuuagggaaaaaaaucucaaguuuaauaguguucuaagaaugagaggaaacugacaaauuagcacguguuuuuuuuuuucuacaagauaauuuaacuugcuuggaacaaggacuucuuuaaaaucaaaguaaauacuucuaggguuauaagaaguaaaaauuuaauuuagaauaaaauucuucugauaauucagaaacuuagguguuuccaaaguuuaaaucuucuacucagaaauuggggugugagaguggcauaaaaucacaagaaaacuagggcgacugaaaaccuguggggccucccauauuagcuucaauacuuuagaauuuuuuuguauauaaaauuuauuauuuucuucaagaugucauguuucuuauugguuucagccuggaagugucuaggaaaggagacacucuuggaaauagguuggugcaaauguugguggacacucuuggaaauagguuggugcaaacauuagcuucaauugaagguaauggcaaaaaccacaauuauguuuacaccaaccuaauacuucuguaguugcuaugggucagcagcuguauaguaacaggcauuacaaauaggaagugugggcaggugagcagcuaugguuagaguagcccaacuucaguuaucacaaaucuggccucugugcuucgaagguauccccagaacagagagaucaucaauauaguuaguaaugcuucugguuucugaaagcucuacaaaaaguuccacuucuguuaguuuagucuucagucuacugaauuuucaaguucuacaacccugaaacuuuggauuauuuuucaauuuguuggugaccacgcuuggaacuauauuggccugacaugaagugaaugugccugauggaaaugaaaacuuugcgagguucaauguugucuucacauggcauuuguaacuaacccuuuuugauucuugauucaauguauuuaucuggaauuuaacuggaaccaaugucuaccauauuggcucuuuucugcaauugcuuugaccacauuugguuuggcuacuguagauuuuaaagaaaaagggguaaauguccaagagugguggucuucaggugaacaccagguacaggcaaaagagagugauaaucaguauaacgccagcaggccugagggccaaugagcauuguccucuugcugcguaauuuugucuaggaaugacuuuaauaaaaugcucuucaguuuuauuuuaagacuacauuaagacacaguuucaaaaucccaaauguauauauguuauuaaaaauauaaguugaacuuacucuacauucuuuguccaaucaggaggguuacucauugucauaaacacacaguuugucaaaauagugcacauaauuagcaugcugaauaauguagguuauuguuaaggaacacacaaaagaaaaucaaaauccaaguguuauauuacaaaaagcuaacauugaaaagcccaaacugcagcuuagccaaaauucagggauaaaugcauugugggcaagucuucuaaucuccuuacauuucaauuucuucauguguaaaauguggguaauaauaucaccuucacugaguauuuguauagauuaaaugagguaauguauaugaaagcauuauaucaguauaagguguuguuuuuacaacuauuauuaaaucaauauauucaccucccagagaacuucagugggaagacuauuuuugugcuaccuggaguugcacaguuuuucagcagaaaguauugacuugagcucauucaggugaauaaacuaguaaauuguugaggaaggccacuuaucugcaauauuguaauuucuuaaacacaucuuauccaacacaguucaacgcaugaaaacaauuuguagucaaaguacagcacgaugcuaauuguuggguugcucuauuuugacugaguuuauacaagugcagcaggauucgauaacauuaaaagugaauauucuugaagguugacacuuaacaugaugggaauguaauuaaaauucaacauagcaaagugauguuggccaagagacucaaccucucugugccauugccuuguaucucuuccuacuucucuacaauggagcuaauaauguacucauuuuguaauguaaccauuucuacaugcagauuaaaugaguuaauguauuggaaaugcuuggaacagucacgguacguaaguaaauauacucuaagugguagcuaaaacaaaugaacagacauaacagaauuauaaaacugaaagggacccuaaaaauuaguuuaucacuauauuuuaaaaaucagggaaauaaggccuuacuaagcucuagaggaaucagauaaaggguccaggacuagaauauaaguuuccuacauuaagauccaauauucuuuccacuauaguuuacugccaaaacaaaaauuuuccauaauugaaaaagaaaguuuucaucaaaugaccacaugauggcgcuaggaauacaaacugggacaaggaaacuucccuaaguauaaaaacccuaucauaugauuuuuauguuucaaaucuuuuaauuuuaguaauagcauauuuauaccacuaaagaaauuucuugcugucauauuaaaauuagaauggccguucaaauuuuagaauccuuuaaaaaaaaguaugagcuuaugauaauuauaaugguauuuuaauaucuauuauugucaaagcuaucaaacaagauacaaucagaagugaauuguuuuccuaaauugauuaacaaaugaauuuagucguggaguccuuuuuaacaccaaugggaaucaugaaaccaaaucccuuaagaccauuuggaaauauaugccaacuucucucauuaacuuccggagucuuuacuaagcaaacaguuuugcauggcagcaucauaacucaugacuugaauuugaaauucagccaauauuccaguacuuccuucacaaaaaucaucaggaaauuucaagaauuaacuaaguacuggccaaagacuccugacauucucugacagaaaauauacuuaaagguuuauucuaagauacacugaaguguuuuauaucauaacuauggauaaacuugagucuggaaguagauuuuucuguuaucauaucauugcucacugaaaauucuacaccaucacaaacuuuguauaaagaugguagagguaaacaugguuaucuuacuuuagauuuguaggauucaauacauauaaguguuuuuagaaagauaacaaaaguacauaaauacauguuuauauauaauauauaaaauguuaaagaguacauguuucaguaaugucuaugugauuaaugaacuuuaagaaugaggcuaauaugacaaagaugcaaaaugagagugaugaaaacuauauaauauggacauuucccaacuuaauuugauauuuagcuauaaagugcuuacagaucauguacaaauaguuaauauuaaucacuugaaaaaggauaugaauguaccaaaaucuuaauagcuauuuuccuaagaggauugaagggaguuaaaauguacagggcagagguggcacugaaccggaagauggccuucccuuuauucaauacuauaaaagucuguaagacaggaacacaacauagaaguaugaaaguauaaaccacuuaaacucuguuaucuacuuucuguuacuugucauaauaaauuauuguaaaguuaaaugagaaaccagcacaaucacaauuucuaaagugccccaugaaaacaaacugucacuggaucucuucuuaauuagagaggaaauccaaugauaccacuuaccuuuuaccuaauacuuacccucaauuuuauuguacauaagacaauuagccaagagaagucauuuauuuucucgauauuuuaagugucugaguuaaaugaaagucuuaaaugggugcacauuucauuucauuccaaaaaacuuaaggcacuacaugcuuuuuauagucauuucagcuuucccaauucaaauaucuugaaaauuaauccuguggaacgcaaaaucauucaacagaacugauacuauuuuugaaauaaagauuguuuuuaccaucuauccucauaaaauaaacauuaucacucucuucguaauagaaaauaaaaacagccaccaucaaacccacucuuggguuagauggauguaauccaauaauugauuucuggaggccaagaucccuggagaguacccguugaccaggagugcuaaauucuguacugggauuucugaguuagcugacauauugaauucuaaucccaauugacuuccuaucuuaugcagugcuuucuuaucacagaggagaagcuccaagcuccugaagaauccaggauccaugaaugugaaugaaauuccuuccaaaaauuagacuuauuugagaucaauuggcagugggcagacaaaacauuaaagaagcaacauguaaggguauaaaaagggcucugacucaauguuuuccaaggugcuuacuuauauuuagacagagccagggagaaagccuuuaucucugugaagagcauauuuggggaaggaaauuuuaagcuucuugauuuuaaauucacccauucuucgaaagcuuucuuuucuaagccuuaggaugcauaucugcacagaucauguuaugauacagcaagcauaaauguuauguuuauuuucuacuaagaaucuuuguauagucuuagcucauuaacagauuuccccuauacuugcaggauuuucuaaauucaaguaaagcaaacccacccucccacaccccuaccugcuaauggaguugguuuuugaaaauuaagcacuuucuaucugguauggguagaaguguccuaaacuggcugugaaaguauggucccccaaccaguacugguuaaguauagauauggagaguccauguuuagaaauuuguaaggcaauuuggccaauuaauguugugucugucuauucuaauaauaaaaaaguagggggauguuguugugggccuguuuuucauuucaguuuucuagaaacuaauuuuuacuucauuuuauagaagaauagagaccucacauccucaacagaguuugagaagcacugcuccaagucucaccucugccugcauucccucuaucaucuuugaaggaguaugaguccagaaaacagauagagcuuuaccacaaagcgcauuugaaggaagggagaauuucaccugugcuuacuagaagaacaauccccuaugccaacaauacuuagcccucuuuuucucugauucauugagggauucugucccugaaugacauugugagaucaucguaaaucugaacagacuugugcaaugcaaaugccuuugcugugggggaauaugagcauguaacgacacagaaaggcccaaagugagcuagcucaggaauaaauaugguccaccuuucaaauguacugcauauacuuccuuuccccccagauaugcugaguaaaaucugaaagaaauauuaggggcucagauggccagucgcaguggcucacgucuguaaucccagcacuuugggaggccaaagugggcacaucaccugaggucagaaguuugagaccagccuggccaacauggugaaaccccaucucuacuaaaaacacacaaaaaaauuagcugggccugguggugggucccuguaaucccaguugcuugggaggcugaggcaggagaacaggagaaucgcuugaacccaggaggcggagguugcagugagccaagaucgcgccacugcacuccagccugggugaugagagcaaaacuccaucugaaaaaaagaaaaagaaauauuaggggcacagguaggagaaccaguaaaaauauaacacagaauauauauauuuuaaaauaagaaucucuugauuucagauaauauuaaaagcuaauuuugaaacaaauaguagugauacaaagagauaaugagaaagaaaugacaauccauagauggccuaaaucaugggcuggagugugaggauaaucaagaugguacuguuuguaccuccguggauaaggaaaauaaccaggcucauccuaaggagacaggaccauacuuagaagagaacaccugugaugcuggcuccuuggccacuguucagcccaaaccaugaccagagguaauaaaugaccaaaacagaaaagacagacaaggagugguaaaguaaaaggcaaagcuagagaucuaaaagaagggaggggaaauauuucugcccugaguacuaaaaaguaaaagaggcaagauucagaaaccaaacacaaaagguuccaaaaaggaagucugccuagaaguaaaaagagcagaggauucuagacaaaaaucggggaaagguggggacagagagaaaucuguuaaaggacacaaaauuacaacuagauaggaggaacacauucuagcucuccacaccacuguaggaugacuacaguuaaaaauaauuuauuauauaguuucaaauagcuggaaggaagauauugaauguucccaacacaaaaaaugauaaauguuugagaugacggauaugcuaauuauucugaucugaucacuauacaucauauguauuaaaaccacuauaugcuucauaaauauguacaauuauuacgugucaauuuaaaaaauaagauaaaaggagguauaaagggcugaaacuaaguaagaugaguuuaaugaaaccaaagcacucucaauguugguaugugauucuaaaucuaaaaguccuuugacauagagaaaauuaauacuuugacacaaaaguuaaaaacaaaugggcauaauuaucaauuguucaagccuuagaugaaaacauuuacugauuuuacaguguauucccuuuauucauuuuaaaaauuuaaagaauguguagaagauuauuugguaacaagauuuauaugugcaauggaaaauacuugcaaguugaauuuauaaauggaauugguaagguuuuuacugaacaacgguauuuguuuugcuuuaauuuuucauaagacauacuguugugcaagacauccuugcuacccaggaagcuaacaauaaggccaacauuaaaggaccauuuuuucauaggauuucuucugugagaacuccauuuuucucagauugaaacauacaugcuuauguacaaacuucauagauguagcuuuaagguauugauggauuuuaaacagccuuccaauaaagcaacaguacccagacuuguauagcaacccaauauguauaauuuuaaauaugauagcacuuucaugucagaguaaguuccauuuagaaugucagucuuauuauauguaauugaucuuauguuuguuuauuuccucaacugucuguaucuuaccuccuuguaauugcuuacauagccaagaagccgaucauucaguuuauaaguguuaagaauuaauaaaaggauacuuguuuccaaggacucucagauacagcuuucucccaaaaguggcauugaugauauugaagggagggaagagucugaaggaaauacuguuugcuuacaacaaauacuuaaguagcucuagaguuuucaaauauauaaauauuugccuuccccgcuauacguauaagaaagggcuccaagagggaagaguucaaagacuagcuaagauauugcuguaccuuaaacuguauaaacaaauauuguguagcuuuaagcuaaucaagauuuaugaacuauuaaauugggugacuuuuuaaaaacuuuuuaaaagaauguauugguuagcuuauuauagugaaguaucuuagcauccuuuaaaucuaauuaguucaacaaagauuucauuaauacaacuuaucaggauaacuuuuauugcauuaagucauuugaauaaaaaagaaacaguucaaaguuggugguggaggagaaaagguuuauacaguaguaucuagcccaaaacaaaccccuuuuuaccacccaaggcucauaggaacauugacaugacuggcuccacuuacaagcagcaagacuuugugguuuaguacaauucaggcacaucuaugacuauucuuaauauuuguccuucaguucauuuuagugccaaaacaaaugcuuuaauugcaguucuacaaagaaauagaacuguuugaaauuaauaacaucauuuuaacacguggauaauuuucugcuucaaaacaaauguugaagcauggcauuguaacugagguaacaacuagauuuuauauaugaaaaaucacuuuacagacuuauuugcaggaauguaacauucauacaauaggguuguucuagcuugucacuuaugucuucauauacagguaccaaguuuauugggcauauauacaauaaguugguaauuauguaugagcagggaccuaguuuagguccaauuguuaauuucaauugauggcaauucagaauacauguauuaacuguuuaguacaauauuugcaaugcccugugcuacauucuaaagagaaaacaaagauacauagguuaugacaccaagacauuuauaaacuaggagaugcucaacuauuuguuuuaauagaauauagaagaauugaugaagguuaccuugaccagcacuuuccaacagaaauauaauguaagcuacaaaucugagcuacaguuaugauuuuaaauuuccugagagccacauuaaaagaaaaacaaagcaggugaaauuaauuuuaacaguauuuucuuuaacccaacauaucugaauuauuaucauuugggaaugaaauugauauaaaaaauuuuugagauauguauauuuuuauacuaagucuuagaucuuugaaauauggaguuacacuuacauauuucaaauacucaauagcuacacaaggcuaauuaaucucugcuauauugggcagcacagaccuaaacuuaaaccauccauuguucagcaagcucauaccuucuucagcaauccuugccauguaaaaaucauuucugguuuuaaagaaaaagcaagaaggaaguuauauagaaaaauugguaauaacccugguaauuaacaguuuaauaaucugggaagcaacauuaugaaaauauaaguaugauuuguuuuaucuuauguuaagggugcaaacucugaaauuagauuucugauucaaaagcuaacuuugcugccuuccagcagugugauccggaacagguuucuuaacuuucugugacucaguuaucucacuugaaaacagaauaaauguacuuagcucauagagguaaugugauuccaauuuagcuggucagauuuugauaccuaguuuuuauacuuuaaauaaguaauccagaugauucugucauagcagggcuguuaauauguuuguuaccuaaugguuguaaaaaaucacaaaccauuggccaaauuaucaaugauuauguuguacauguggauugaaaucuugccccuugaucuaacugaauaguuacuaagaaaauaauuauguuauaaugauuugguagaaauugcuauuuaugaagcuauauuuguuauuaucuaguaaucuuuucuuguuucugggcuuauagaaagugauuuguuuacaauuuuuucccaggauggacauugaauuuaacaagccaugguuuuccaguuucuuuuucucauuuaaauauagccauuaccuuaacauuuauuucaaucuaggggccauauucuucaaaguacauaguuuaaacauaagcuguaacuuuguguuucaucuaaacauuauugaaacauugccaaauaacaggacugacuccaaauuuauugcacuuuccuacucuuaaaguaaaucuacuggcaaaaacaagaaauaacacaggaaggugagcuaugaugaugaacaauacacaaaauguagaauauacuacugguugguuaaauuuauccuuuagcuucaaaguuugaaacaggcaauuuccaacuuguacaugagcugugcuccagaaaugcauuuggaagucaauuguuuggaaaugugaacauauauucucacagauacacauauauuucuagacccacaggucuaucaaacuguuaaugaaguacaauucugaaugaauggcacugagaaacuuuaucacuauguguaagaaaguguuacucugaaaauggcagaguucuguccuugaaauagccuggaagucagaccaggaaaauuaucuggcucuagcuccuacccagaagugcuauuaaguuuuucauagcucuaagcugcuggcuuggaaagagguuccagcaugaagggggagaauuagagccauguugcaagaggagagaugcuucaaaguuuugggugugaagagcagcauagauggucaggagauuccauuaguauaauacauaucucuggggacauuucuuaugcugggucaauuccaugguauauaauauuuuuuccccaaggacuuuaaauggucucaccuacuucccuucucauuugucauagccugugaguucaagccaagcuuuucuuccuuuucuggcucacugggggaugaaaaguuuucuugcaggcuuucuaccugacucugaagagaguaugccauauuuaauauuuuuucaucuccuagucucauucaauuuuuuccuuccaaccagugauaaccagacuaaacaacaaucugugucacuugccuacccgugggccaccaagcuuuaauauauagccuucacuuaaugacagaugugguccuuaagccacagauuacaaacuaaaaugcccacagaggcuaagugacaauagguaccugccaguuuuaggcauauaagucagugaugccugaacucauauuucaagaggaauccuuagauguauaauuuuaugagugugugaaagauuuucugauuuauaaaugccagaaaauaauucaaaauuauaaauaauuuuguuaguuuaacaaaacaugucuguggacuccaugccucacagucaguuuuuaaacauuguugccauaugcucacacaaaagagaagaauuuguaccuagagaagagucuguaaaauugcuuguuccuaugcuuuagcuggguggaggguuggggccaguggaggagauaacucugcagaaggugccucccuagaaagugccuagguaggcuuuugucagccaaggcugcagagcccucaaccucuucuccagcagagagaagaaauuauaacaacaaggaaaaagaauaaaaucuggagcugaaacauuuuucagcccuauaucaucagaauguacauaccaugggucugcuacacuauuauauggucaguuaauuuuucuuugacuggaaagaacacuuuugagcccagcuugauuacaagcuugcugugugagaacuaugagcaaacuauuccccucaauuucuccaucucaauggagaagauuauacuaauaccaaucuuaggauuauuuugaggauaaagugaaauaaaacaugucaaugcccuuagugaauucuaaagugucaauaaaaauauaaggauuaaaauauuuaaaaugcgucucuguauucuaacucuuaaauauacacauauaagaacauuucuguuucuccaaagcauggccaauuuuaguauuggaauuuucagguucaguaucuuucuucucaaacuuccuaucuaagaaaaugaggccaucagcuuccuucugucugacaccuaaacaccuccaaaaccaauucugacucuauccauuauucuccaucuccauugucaaaaugcuagaucaaguauaaaacuccuaaauuucuccauagagaaguugagugauuuuuaacaauguaaaguggaccauguuacugcuguaccuaaauacuuguugggaauucauuuugcuuugaagauaaccuucaaacucuuuaagauguacugaaagauccccuuuaucuagccccaggucuaccuccccaaccucaccuuauucucuucuuaccuauuacaggucagcuugauuauaugucuuauucuaugcuguucucuuuccuuggaagauucuccucucccuccuccuuuuuaaccuucagaucccaauuuaaaugccauuuccuuauagaggcacacaauuuaaauuuccugaauugauccucuuugaaaauaggugcuuaucacccuacuggaauuuagugggaaaaaaaauuucuaauuauuuuagaagcuaaucuagaucacugagugucuaagauuuuaguuuuuccuuugucaccucccugucucugucucagaaacagucccaagauggugauguugauaaaaaugaauaauaauaauaaauaaauaagguuuuacaaaggcaggaaauggccaaguguugaaaugaccaguaaggguucgggaaauacugccggccugggagaccagaaucacaucuugcaaaauggcaugaguaggaaacaggaaggacagcuauaggcuuauuuagauuccaucacugacuucucuuuuuuuuuuuuccacugcugugauuagugcuaugacugcaaauccaaacuaacauggcaaugggccauggaaacucacuggucuaguuuuaaaacuagucuuaggcaaguuauuuaaacucaguuuuauuauuuuuaaauaaagacaagagcuaucuugaaagaaucuguggauuaaaaaagaacaguaauuauacugauauuauauauagcauguagaguacauagcuuuuuuuuuuuuuuuugccugcuuaggacaccuuuucuaacaguuccucuucucuuccuuuuggaguaaaucucugccccacugucuucccauguggcuugguggagcugacccaccccuuggcaacacagguuaguauaugacagagaccaucccauaccaaggagaccaucacauaccacuagccaaagugagugguucagaggaggccaugugaccuaauuagacucaauucuaggacaacugcuagagcuuuugaaggaaaccugggccuuuuuucuuucuucuuucuuguuuuagcagaagauaguaguuacaaggcuguaggauguuaguuuagcaccacugguggcuauuucugccaucuuguggaagagccagccugcaaaugaagccagcaugggugacagcagagcugaccauggaaaaggaguacccucaugacauuguuugagguacuggguauuuugauauuaaaaccagauucacuagacacauuuccuuuauuuuuccccaaaaguuguuucuguuggguuuuggaaacuuucaguugaaggaucuccuauagauauggcagauacucuaaaaaugccaagcaucauuuuauugaucaacaucaccaucuugggacuguuucugagacagagacagggaggugacaaaggaaaaagaagcacaaggaagaaauagugcauagggaagagaaagauugggaagucaacuacaggguccuggauguaagggagagucugggugacuuuuaguuuuacaggagcugaugauaagcaaagaacagcuacacacuggggacugcccauaugacaauucgugaaauuauaagcuuuuaauaaucauccucuuuucugauuucccguuaauuacuuuugcaagaaaaacuccauaauuccaauuaaaaacaaaacaaacucucuccacccaauuuaacaacuaaaaacuccuuuggcagugauagaccaaacaugaauuugaaaucacaaauucauauaugacuucucauggagcccaagaaaaagggagugugcaucuuuucaggacaguugauagcaagagagaauaaguuacuuuuaaaugauccauaggacuuuuuaaaaaugaaugcauuucugcacuccauaauuaacaaacauccauuuuuacuacagaucuaaaaugucucauucuauuuccaguaaacugucacauuguuaaaaugauauuuucuuccaugguaauaaugauucgucuguaauuuuaacaagaacaugagaaggaagacauuuucuguaauaaagaguggguaaagaauuugaauguagggccaaaugguacaaaaucagcccaagcuaugaaaggaaacugugaaaaaaagucccgugagggaaaaaaagguguguucacaagcuaaaaugugccuugcuacacagcuaaaguaaauaaacaaacaaagggaaaccaaucuggaaucauguucuaaagaccacugagucagagcuaacaugauaugaaaaauacugucaccauauuaugauagcauuuuuuuccccugaguuuuuaaccuggaacucugaaggcuuaaaacaucugaggaucuaaaaaccuucuaaugcuucuaugcaucaggaauguucaugaugcauagaugcuacuauuucuuuaguuacuacuacaauauuacugaacauggauuaaacugcuuuaacaauuuuaguagaauauuugaacauuacauaauuugcacaucuuaaacugggacaaagaggauaaaaauaugugggcauaugccauuggaaaauauacucucagcagugacauuuuaauaagcucacugacacugccuuuguaaaagauuacagagagcuucaguguggugguuguguuuuuucuauucacauaaauuccuugcauguacacuacugcacuuuaacauaaaauauaacauaaggaauggauucugcaaauauuuuuacaauuggcuuguuuugucuauuccauauaguugagaaagaaaccagagucuuuguauacugaugcaaaugacacauuaacuauuguacuagaguccaacuuuagggaaaucacuagucuaacugcauauuccauuucacucaggcaaaucuaauccacacccccaguaucagcauuaguggaaaaucucguccuaauaaacauuuucccuggugacauuuccacuguuugaccauuuagcugugucaagaguacuguguauguguaccgcauuguuuuaaugaagaucacccagccaaucucagauaacccagucacuaaaguaaaauuagucaucgaauauugaaagaaauauucauuauuuuuaaaagguucagauuuugcuaagcauuccaacuuuagucagagcaaauuaauuccauuuaaggauauuuuucaauacugaaauaauccaauuagaaaagaaaauuaaaggcagaaaaaaguguacaggcaacuuauaaaagucuuaagacauaaaaaugcagaagaaggaaauuucaaacacauaacucaaucauguguucuaagcacaccauguuaguuuuuaaggauuucagcccugcaaaaagcuucgugugcauugcuguugaaugacuuacauuugaagauuugcuugcugucaguucaauguaaaagccaugaguauaccuuaccuuggggaaaacucuuuccugauaacaauauuucccuuaucagguuguucuacuugcacacugugauuugcuccaaaaugccaaaaugcuuuucuuuccucauaccaugugcauuugaagauaagaacagaagauguuaagagcaaguuuagacgugagccuaacaaaguuuauaaggguuuccucgacacaagaaucuggcugucacuucaucagaguuggccuuucacccucaguuuuaagauguuucuuuugaguauuuugaaaauguuugcacaauuuuguuuuacaucugucuuuauauccuuugcuauauauaauucauuauaaaccaauuauggaccauuuuguuuagggacauccccucgagacaaucacuuuuaucagucugaaagcucuuuaauuaaagaaaaaaaagauugauugguuguucugguuuccagaugaagaaugucuaccuuugucaacaugcauuaguuuggucuuucucaaaacauucauuuauuauuuuacaaauaaggacccagcauaggagcagagauacuaaauuucuucccuguuugauuaagggauagaugcuggguggcuuuaauaauuuuuagauggugauugcuaccaaagaggugaggacccggugucuggggguagcaaaaggccuguugaggauggagcccacuaacauaucccaagagcagccucugaauaaacuaaaaguauccaauggcuauaaauacaguagcauacucuauacugugaaugaauuucugccuggaacacaucagucuucacuucaauaccgaagucauuuuaaacgaauuaaaauguuuaggcaauuggauuaucugcauuuuuacuuuucuuauacaaauaaaguccuuguaguuuguuuaguuugggcuuuggcuuuucagauacauuaauuuccaaagaguugauuaaauaauaaagugcaacuuuucucauaacuuaaauggcaguuaugagauuaauaaucucuuaucaacuaagauuugacaauaugguguucaaaagcaaaguuagaggaaaaugaaauacauggaaaaugauccaucccuuccucuacuguaaaaugaauagaucaguuuuuaaaaaggggaaauauguagugauuccuaaaguaaauccuaguaccacugucaacugauaauuuuaaauguaauuuagauuuguagaugguguaacauuaaaguuguauaauguuuaaaaaaaaaaaaaaaggaaaauacuggccgggcgcaguggcucacgccuguaauccuagcacuuugggaggccgaggccgguggaucacgaggucaggagaucgaguccauccuggcuaacauggugaaaccccgucucuacuaaaauuacagaaaauuagccgggcgugguggcaggcgccuguagucccagcuacuggggagacugaggcaggagaauggcgugaacccgagagguggggcuugcagugagccgagauggcaccacugcacuccagucugggccacagagcgagacugcgucucaaaaagaaaaaaaaaaaagggaaaauauguuauacuuaaacugacuauauccugaaaaguuaaaaaaaaaucugaaccuaaggcuagucaaccuuuugugacgcucuuuccuccgaaacuguagcugucaaucggaagugauuuauaaaacugccucaaauucacauauuacaaaugccaaacuuuugcaugcauuuggcaaggacuaacuucacacagaacugggccagaaacagagucccuaaaaguuuaggggguauuuuaagguccagguccaacaaaaaaauuuacuuaauuacaaucuuugugcccuaccuuuccacuaagauucacaaaugcauugugucaagugauaaagaagaaaauguuacgaaucaccuaacgucauacauuuaauuuaaaaucaaugcaauaaucuuaaaaaaaauuuuaugcuuuuuguuuugguuuggugaaaugacagucauaaugaacgguuggaugcuuaacauaagauucauuucaagcauggauaugaaaaaagcacgcauucaaauauuguuuauagguucuucagguuaugacauuuuuguuaauucuugccaauauuaguacauuaauaccaaaauauuaaauaacuuguaaaauucuaguuuauguaaaaauguuauuuuacagguaacaaaauuucuucaggaaauuaauugauuuguuguuuauaacaugacauugaaauugcaaacccuuguggcaucaaauuuguuugcaugaaaaauuaguacuaauauuuuguauagucuuuauaacucaugauuuugagauuuccaaguauuuccaaguacagaaaguacaaaaaaauuguauaguaaaucgaaucuguggagagaaucugucaauuuguuaaauuagcugccucuuucuuuccuuccuuccuuccuuccuuccuucccucccacccucucuucuuucuuuuuuuuuuuuuuuuuuuugacacagucuugcucugucuccaggcuggaguguaguggcgucaucucggcucacugcaaccucggccuccaggguucaacaagggauuccccugccucagccuccugagugacugggacuacaugcgugugccaccacgcccagcaaauuuuuuguauuuuagcagagaagggguuucaccauguuggccaggauggucucaaucucuuaaccucgugaucugccugccucggccccucaaagugcugggauuacaggcuugagccaccgcaccuggccucuuuuuauuugucauggugcauuugggacaguugcauauguuaugauauaaucaauucauuucucauguauaugcauaaaccacccacaaauguguuucauuucuuaaacagaaggauacuuaagauuuugugcuaauuuggcauguguuggugcuacaacaguccaaggaaugcaguaggcaauuagcagcaaaauaugccugauaaaaaacacucacuuucuuauugauauaguagggguccagguccuccaggggcucugacaccaucucuggaggaaugucuccauaaauaaauggaagguucuuuccagcuuccaagucacuauuuggcuuugggccauuuucgucgucaucuuuuuugucugguuugggauucuuugccuuuucuucugcaaugcgucuuucaauagccgcaagagauucucuggugaagaaguugaagcugucagguccuggugguacaagcacuguuugcuccaucuugucauccugcacauuuuaauuaccauuuauucugcauaugaaauuccuaaaauaaaaggaauacagauauuuuaaagaguggacuaagagauguuaauauaaauaaauucuugucaugaaacaugagcuagaggauuuaaagucuguuuucuccuuaaauugaaaggugauuucuaaagaaaaaauuuuaacacaaaugguuucuguguugaguuuaguuaagcaucacuuauuuauuaauucuugugcuuuacugauacaggaacugugccaugaguuuuaaaagugguucaaauauggccuuaaucaaaguacauuaggcuaauuaacacuauaucacuaaugaguuauucagucugugacacacccagaagauggagacugugcguauaaaggcaaaggauagcucauuuaacaaggaugaggggaaaaggaauugucucugagaggacauaaaaucuaacccucuaggucugacaagugauuccuggccaagauagucaggauaguuugcagugaccaaccuuaaugaccaaucaaauaguuauugcugucuugacugggcuuuaaccucuucuaagauuugagacaacuggaacuauguccugcucacuucacuagccaugcaugguuggcuuacuugaacacauaaagauaaagacaguccacgguuggacaaaugucauuuaugugaguaagaaggagaggaaaacuaggcuguaaagaaauugcuagauggagguggggguggaagaagauagcuguaggugcaggagacagcaggagucuccuguuucaagaaaaaugaucagaaagaagucagggugccauaaacucaauagaaacuaaguguuuuucuucacugaagcaauaaugaaauucuugcugauucuauaguccuauagugcuaaccauauuaugaaggccugaggcaaaaccgucaaccccauacagcagagucagaccugaucugaugccagacgccaaaucccaaauguauuguuuuaaggcauauuuaauaugagcucagauuucacagauauuacugagccaaaauauuccagagccuaagcugccacuuggccaugaauuuuauuuggagacugcauuaacucauuaaggucagcaagcuaugguacaguuaauuauagcuuugguguauaugaacuacaauaagaaaauugcaggcauaauuauuuugugagggacagagaccucaaauuucaaggagguucucauuguugugagguuuauaaccauauuuuucagaguggaugaucaaaagaagggaggacucaaguuuaaauuuguacccuuagucuacuaagugaaguuuucagcgguucuuagaacuuaaccugcaguuauuuaguaccugcaagaauagguugucuguaaaucaaugaaaacugaauguucugucuacaaacucugguuccccuacaaggcaucaggaaaauacuaacauuuauuuuuugcaaauaaaaguuuagggauaacaaauauaguaacuuuucucaaaagggaaauaaaauauucugauguauauauauaguuuuuauuuuuaaauagcuuuuugauagaaaauauauguaaaugauauaaaugcaaauaucuaaaagaaaaugcaguauaauaucuccuuuuuaccuuguuuccccaggcccaguuccccuuccuagaggcaacuacuacuacuuaucucccauauauauuuccagguauucaauagguauaugcuagaacaugaguguauguauacauauucuauuuuaaaauacauauucaaauggaaucuuauuauacaaacuguuuuacaccagcauuuuuuacuuaaaauguauauuagaguucauuuaucuuaauuuuuauagauuugacucguaccuauuacuggcuacauggguuuccauugcauguuaugugccauaauuuauuuaaccaauucccugaaugugaguauuuggguuguuuccaaucuuuagcuaauauugaauaaaguugcaaguaauacauuuuuacacacauacuuucaaauauauguggauauauuuauaaaauuaauuuuuaaagguagacuuggcuuuguacagaauguuuauuuaugauaguuacugcaaaacuacuuucuauggaguuuguaugaacuuauucuccugacagcaauguaacagagugccuauuuauccucaccaauauaauauguuaucauauuuuugauauuuccaaucugacagggacaaagaugagagcauauuauaauuuuaauuugcauuugucuuacuaugagaaaaguggaauauauuuuucuuauacuuaagaauuauuuuuuauuuucuuuccugcaacugcuuauuuaaaaacagcccauuuuuuccuucuauuuuuuucaaucuauagcaucuuuuaagacaaaauauuagccacuugauuuuuugauguguggucuuuuaaaaauguauauuuuuugacuuuauggugcuuugugcuacagauuuuaaaagauuuaauuaaaaauguuaaaauuguuaggugauuaucuaauucuucuuuggcuucuggauacuguauaaugcuuagaaaggcauccagagagaugggcaguaagggguaggaaaaaggauauaaaauauauacauacacacacaugcaucuguaucaccuuucccucuuguauuuuuaguauuuuggugguuuaauguuauaaguuuaaauauuuuaucuauuuggaauuuauuuucuauauggagugagguagagaucaaagaacaacuaaauaaaugcagagacaguccaugucuuugaauaggaguguucaauauaucaaagacacuaguucuucccaacuugaacuaaagguuuaauuuaauuucugucaaaaucccagcaguuauuuguggauauugauaaacugauuuugaaguuuauuuggaaaggcaaaaaacccaaaagagccaacacaauguugaagaagaacaaaguuggaggacugacacuaacccaacuuuaagacuuacuguaaagcugcaguaaucaauacagugugguacugacaaaagaauagauaaguggaucaauggaauaggauagugaguguggaagaaggcccacauaauuacagccaacugaucuguaauaaagaagcaagguaauaaaaugaagaaaagauagucuuuucaacauguauugcuggaauaacuagacauccaaaugcaaaaaaaaaaaaugaaccuagaccuuaugccuuucacaaaaaauaauucaaaauggaucacaaaucuaaauguaaaaugcagaacuaaaaaacuacuagaagauaauauuggagaaaaccuaguugacuaaauuuguugauaacuuuuuaguucucuguuuuucuuggaacugucucaucuucauauuugaguucuggaauauuucuggugauauucucagugcuauauauuuguuuuugguuuucuaggagugauggugaggaggaauugugccagcuugcuucuucacugccauuuuggaaccagaacucaggugaugacuuuuuagauauaacaccaaaggcacgauccaugaaaaaaaagaauugacaaucugauaucauuaaaaugaaaaauuuugcucugugaaagauacuaucaagagaauaggaaggcaagccacauacuaagaaaaauauuugcaaaagacaugucugauaaaggacuguuaccccaaacaugcaaaaaauuauuaaagcucaacaauaagaaaaugaacaaucugaauaaaaaaugggccaaagaccugaacagacacuucaccaaagaagacacacagauggcaaauaagcauaugagaagaagaugccccacauccaucauaugucauuagugaaaugcaaauuaaaacaauaagauagcacuacacccucauuagaauggucgaaguccagaacacuaacaacauuaaaugcugaugaggauauggagcaauagaagcucacauucauugcuggugggcaagcaaaaugguacagcaacuuggaagacaguuuagcaguuucuuaaaaaccaaacauacucuuaccauaugauccagcaauugcauaccuuaggauuuaaccaaaggaguugaaaacuuauguccacacaaaauccugcacacggauguauacagcagccuuauucauaauugcccaaaccuggaagcaaccaagauguccuucaguaggugaauggauaaauaaccugugguacauccagacaauggaauauuacucagcauuaaaggaaaugagcuaucaagccaugaaaagacauggagaaacuuuaaauacauauuacuaauugaaagaagcaaucuaaaauggacauacaguaugauuccaacuauaugacauuauggaaaagacaaaacuacagagacaauaaaaagaucagugauugccagggcagugaaaauacuuugcaugacacuguaauaguggacacaugucauuauacauuugugcaaacccauagaauguacaauaccaagauugaauuauaauguaaacuauggacuuugggugauuaugauauaucaaauuggguucaucaguuguaacuauauacaauaccuaaacacugucucuaaaauagcucuugaaucaaagaggacuuugauucuaauacauauaauauagcacauauguuaaaauauaccuauauacaauacagguauauuugaacugcguuuaauuuguuaauuuagggaaaaaauuaauuuuuuuccuaaauuaauuuucuuccauuguauuuuuucucuucuaaauagauuauuuuuacaguaauacauaugugcuacucuggugcgagauauugauaguugggggaggcucugcguguguagagaaaggggaaacucuauauuuuuggcuuaauuuugcugugaaucuaaaacuacuguaaaacuagucuauuucaaagagaaaaaguacaauggaagaaauguuucuaaauacaauguaagcauuuuuuaaaagcuuugaauaaaccaaaaguaaauauaaauggauggaaaguuauauccuauuauuagauaggaaugcuauaucauaaagauauuaauuuucccuaaauuaauaaauuaaaugcagccuuugaaaaauaaucacaaaauucauauaacuagagaaaucuauuugagacuucauguggaaaaauaagcaaacaagaauaaccagaaaauucuuaaaaugaauuuugguuucaaaguccucacugaugcaagaacuauuuaaaagaaaguguuuaaauuuuucaaaugauagauuuuccuucuaaguuuuaaauuuauguuuaguuuuauuacccuaugcucugauaauguaguucguaccauuucuguuucuuggaauuuauugugauuuauuuuuauccuaauagagguuguuuuuaaaaugacuuuucuaagaacauuaaaaagaaacuuauucuuuauuuuaaagcaguagaguucauuaugccucaauuauauugaucuuauuucuuaucuuauguagaccuucuaugucuguacauauuuuuuuucuacuugacuguuccaaguugggagaggcaaauuaaugucuauuuaauguguuuuuauuuauugugguuucugucauuuuuguucuaugaauuccaaugcgguauuguuugauguguagauaacacuuaugaucagaucuuuggagugaauugaacccuguacuuccuuaaauggcccuuguuuaucuuacuguaguuucuucccuuuaaagacaacuuugucucauagcauauaaugacuuuaauuucuacuuauuugcacuuaucuaguaugucuuuuuccaucaauucgguuucauccuuuucauuuuacuguuuuagcacuuuccuuaauauguauauguuuagauaucauauauagguauauuuuaacauaugugaucauuacgacaaucaccgucuuucagagugccacacuugauguuauuguccaugaaguugugugaauggacagaaacaguuacuaaaagccuuccuauucuccagaaauacugcauuugagaaaagcucucuaaagaaaaucucccuggucacuagcuaucauuuacuggagaaauaaacaaccaagaaaguagaagacaugaauucuacacugacaaauaugaucaguucaaacguauuauauauaauuauaaauuaguuagauacaggaauuauauucauauguaagcaauauaacccauauuauaaugaaaucauacugauacuagaaaaaguauuuuuuuaacucuaaguagaucuucuauucaaaugcuaccuaaaaauaaauuauguuauauuaauuauaagaauaaaacucauuaaaaaucucauaagguuaauuaugaaauaccuaaaaaacugucagaugucauucaauauuaauauuuuuuaguaauaugaaaaauuguucuaaauuacauuugaaaucuguacuuauucuauuaaaauacagaaauaaaucaugaauuuuccauuuacacuuacaaaggagauuucaccucuuuauucuaaaaauuuauaacagaagacuuaauuguccuaauuuaugaaaauacaugucacuagauacgggguaguaaccucauagaaucugcaguuuuggcuuacagcuuucucuuuucauaaaaaccagcauuuaaauauuugguuacauagaggagaccuugcuccuuucaaaagagguaagacaaugaaacuuuccuaacaagagaagacuucaaagagagaggccuuuucaagaugauuaugguuaugcauuuggacaaaauaaaauuaagaagagaacuaagaaaccauagcuaggaagaaaaaguaacaaagugcauguuagcaaacuucaaaucugaaggaauuuuaaaaaauauuggaaauaaguagaguagugggcaauagaaaacuggaagaagaaugauucuuuggaagacaagaaaaauacauuaaaaguggaauucaauuagauaagcaauccuaaagaagacaggaaaaaaauaauccaaaagaacaugaaauggaagugagagaucaugggggaaaaaaaagauuguaagaaaaugaaguggaaauuuugaguggaaagaaauaguaaaguaauagcaauaacaugaccaauaucaaauaacguggacaaaagaauuauaaggaaaaauuuguuagaauauacaaauaauaaauaaagauauaauaucaucugguaauaucuaacugaaagaaaaagagggagguaaaucuguagcauuauaauuaacagauuaccuucucgggagacuuuacaagaucagaaaguuaauacugauaauauucagugucauuucuaagacuuuacuaauucauuacuuaucauaaauguucuaguacuagaugagguuuuugcuucugggcauuauauaucucuguuucccguagaagaggacacauguauuacguucuggacuugaggaggcauuuaucacagccaaaagauguuuauacuugaggugacugggagugguaaaccauauggcuuuggugacccucaaagugcagauggaggagcuuuauuuaaaguaauccuaacccaugaagccuuacaguuaaacucccuugggcaucugcuuuucuccagucaaacaaauauguacgauagcucacaaugaaguauuucauuuucccuguggcauuucacacagaagucuuaacuguaaaggcaaccuuauaaaugcuuuguacccgaagaaacuggccuuuuauaaguaaaucauuauguaguuucuuccuuuggagggcagcucugugugacugcuugggccucugugguuagaucuguuugguuaacgggcuuuugggcuuucacacaaagcuauacucuccacaaacuucugugagauaaaaaggugauaucugucuuaguccucugaauauuuuuucuuuguucagaaccugagaaagaugaaugaaauuuaguguuucccauccccgagagacacccagcauccacaacuucacacucugaugccauuguguauuuaugcaagaaauaccauaacuaagguaaugucuugagauuuuuugguucaauaauguccuuaaauucuauguuguuuuuaaagccuaaaagaaauucccccuccucacucccccgucucucccuacaaccuggugagacaauucucucauuuucuccucccaguuuccaaugcuauuguuaugaucuauuagaauaauugcuauuauuuuuuugccuuaucugacccuagaagugauuuacagggaaaaaaauuacuaaccaauugauuagugaacugaauauaaagugcagcucuuaugguuuauucacagacaagaauauauauaguacuuaaugugauaguauuuuguuguugauguggaacaguguuagucuauaauacaggcuuucaggcagacaagaccuaguuuaccuugaccucuggacuucugaaagguugaguaaguuauuuuaagagaauuagacaaagauaaguaaaucaaaaccaauaaauggcaaagauuuaaaaaacagagauuagucuauuccucucauuuaauagaaaacaaacugaaucaaagaaaaaugggcaauuucuuuguuuagaacuuaugugcuuccuacuuucaaaauaaauaugucauuugucccagguuacgcagcuuauuaauggugggacuuaaaucagaacuuuuauuuucuaacucccaaaccagugucugccagguccuaauaguuaugaaauauucuuuuaaagcuaaauaaaauauaugaaaauauaaguagcuguguuaaaauaguauuuaucuacucuaauugaucuaggucucuccaaggaauuuauauuacuuggacagacccaaaacaaauacaguaaauaaagcauucuggcaaaaauggagacuucaaaauuuugaaaaaugggagacuccaaaauuuaaaaagaugauuguaauauucaaguuuagaaucauaugaugcagguuuuaauccugcugaacuauaccuccaccgucaauuuauguuuuacuuccguuauguuuuauguauugcuaaacuggauuauuucuaguuacuaacugagcagaugacuuuauauaauuuaucuguaacuccaaaguucaauauaguugugcaacauuuauauaucuucaccaccuuauaauauauaaucugauguggagaaaaauuauauaucuucaauucugucuauaaaguaguuuaauauccauacugaagagaaaccaaaaagacuucugccaaaaugcuugccaucuccuuguaaagagcuauuacuauucuggggacauaaaccaucugggcacgacaauuugugaaguguuucaguucguuuuguaguguucuugccaccuacuuuacaaaagaauguuacugccaauaauaauaaaaauaacuagguaaaauguuauucuuacuguugugaucucacauaacuauuuuuuagcagccaagaaagaaauugguuuuuacauagaaaucccaaaccuagaaaguauuguuuuauaaauuucuuuucuagaaauaauuugauuugguguaauuauaauuacaaaaauauuucauuugauuucucaauaagccaauuuuuaguagguugggguuaacuaaaacaacauauuucagccauauguuuaaaacuuuuacauuuaaaaauaacuucauuaucuacccuuaguuuuucaugccuuaugcaaacugcaguuaaaauaaggucagauaucuaacauaugucuguaucuacauuuguauacuccagggguguuuuucaagacacccuaauaauaaacuaagaaguaaaaaauucauucaaucuacauacaauacauagaaauacaauacauaguuuuugccugagauucagaucucaggcaaaaaauucauucaaucuacauacaauacauagaaauacaguacauaguuuuugccugagauucagaucugccauaguuuauuaggcucugccuguaguuuucucaugaaacacaucaguaucauuaggaugauuaauuucauuuuuuuccuuacagagaagauugucauuaaagaguaagaccauggauaguucacauaauaaaucaugugaaauuuaggaucucuucuagacgaucauagucagaauaauuuaagggaauuccuuugaacaaaugucauuaguuuauaucaagaauauaguaaugacugucauuguaaguaaauuauuuaaguuaaccucuuuuaguaaaguuuuccuguuagaaaauaaguaaucuuauugugugggugaguggucacucgacagagauuugggaggauguagagagugaagucuaauccucgugacugugauugugguugcagauuuugagauaccaagugugaggugauaggcacuuaaagcccagugugggccucccagggcuguuuagcuagcaaugagagaggcacugccuauauccaaguuguauauggcagguuuugcacaaaguggauuacucgaagagaaagccuaauggccagucuauucaucuuccccuuucucgauguucaucuuuucucucccagcucuccuuuauucucaauuuucuuuuuuuuuuuuuuuuugcucagccuccaucucacuuccguugcuguccucuccccaccccuucccacucuggacugugccucuccuuuguagacacuucaaguccauucuauuucauucaaaaaccauggucuagaaguaacuuaauguaaacccacaaagauggagacagaaugaaugccauucuucuugcugcucucucagacaaugcaggucauuuuugccuauggugcugguaaagccaggaguuauguagcuauaaguagcagccagaggaaauagugccugagucagcaauugucuuuuuauugcuguggggcaauaaugggagaaaaaaucaggcuugguacaauucccuuugaaggaaaaagaugccaacacuagcauuuuaacacaaaaugcugguuggggguugggaggaaggaugcuuacauuccuucuuuggaaauaucuacuuugauaaccauuuugguaaaauaaugcaguguuuucagugugcaaauccuuucaggacucaugguuguauggcagacgcaccugacagcaauaauuuaaggguacccugagaaugacucuguggucuaaaaagaauguguguuuggaagucugagguaagaaaucuggcuggaaguggccaaccuggaaauuugcuccuuauuauuaaggauuuccaaagccugguccauuccucagaaugugggccauacaguggaugaagcccuuuguuuggauuaaaugaauguugcuagguggagagugcuaagugaaaaugcuauauaaacugcaugcuuuuuacaaacauuagugguucucccauccagcccacugccacuggaccaccccuguauaugaguccuagauaaauccuaugucucccuugcuggcuucaagucucuucuuuagucucuuggccaugaugccaucccuauuggacucaaugguguuccagcacaacaaugguaugauuagacucuguuccugggagacauacaauacccuccuuugguaggaucuauguggaauguuuagucauuaguguuauuaagaaaucauaguuauuuaauuuauguuuuaagacuuucaccuuucauucucugaauguuaguuagcucagggugugaaaugguucaacagaaauacuugagcugcugcagccagaaggauguuuaugguguuaugcaggaaauauccugcagaauucuguguggaauucugcucagagggguuucucuuuagcauaaacucaauuuaaaaauacucuucugcucaaaagcauucuuaugaaaccaccucaacacaaagcaaaacuguccaggcauaguugcuguauggagagauacagcauagaacccacgggcagcggggcugaagcagagaaaaacugcaggggaaagagaaacagauccaggaacggggagaggagaguguugagcacaaauuaacuacccuggggaaugaguaucagguguuugacacuuucacuuuuccaaauaaccugaagacaaauggaaccucccugaguuaugaaaaauugagacuagaaguaucagagcugcagaauucauuugguucagauucuguauauauaaaaucuagacauagaacaagucuaagcaaaggcauauuaucugcaaugguuacuauggauuauuguucagagaagaaccauuuugguauagagaaagcugaaagaacuuacagaaaauaggucuugaaagaugaaaggcagagauaauuuccugauucagaaacucaguauauuaaauuuucuguauguuauuuaucauuuaugauauaaaauuaugcuuaauuuaucauguaaacugaaaauaaaauucuaagcccccugacugaauugaccuucuccuggccaaaaggaucccagaguaaccuugaagacugaauucucagccaugguggaucagggagucagacauaccuccuuauaaccccucccucacuaaccacuaugaggcuuucuucccuaagggcuaaacagaaaucagcccuuucaaaagacucccccacugacauggaccaaccaccugacacuuucccuccauuggugccucauaagagaccacccacuagggaaugauucuagccauuccacugagaaugugcaguaaggauuuuuguguccucugcuucaccuuuuaaugucagagggccgaaaacucuacccucggaucaugcuaaugucgccauuuuuuccacauggaucccacaaaggggcaugaagcucaguugaggaugugcaugcuucuccucucauaaauauucaugacuccuccuauaacuuauugaacauauauauuuggccaccgugcuuagcauaaauuucuguuuccuuuuucccucccuugaagugucuguuucuggcuucuggcuggaaguuaugcuucccaaccugucagaaggucacucugcaggcugcagcccuuuauaagaaauaaagcucuccuuuccaaauuuaugaaccucaucauucuucaggugauaaucauauaaacgucuacuuaaguuugcuuucagucugucaugugaauucagucauucucacuauauuccuuuugugguauacuggucuggguuaaagagacccucuagggauuauuauacaguuucgucuuguuugagagcucagcagcugaugauuaucacagauuuguauagaguggacacuaccagauguccagcacaucugucacagcagaugugacauugagccaagucuauuucugucuagguguaugauacuuggugcuauacuuuggauaugguuugucgccaucaaaucucauguugaaauuugauuccuaauguuggagguggggccuaaugggaaguguuugggucauggguggaucccucaugaaugguuuuugccucauucucacuguaacgagugaguccuugcucuguuaguucucaugagaacugguugaaaaaaaaaaaaaaagagcagccuggcacgguggcucacaccuguaaucccaggacuuugggaggcugagguggguggaucaccugagguugggaguuugagaccaggcuaaccaacguggagaaacccugucucuacuaaaaacacaaaauuagcugggcaugguggugcaugccuauaaucccagcuacuugggaggaugaggcaggagaaucgcuugaaccugggaagcugggagggagagguugcggugagccaagagcaugccauugcacucuagccugggcaacaagagcaaaacuccaucucagaaaaaaagccuggcaccccacccugucucuuguuuccucucuggccauguggucucuaccccacacaggcugcccuugccuucugucaugaggggaagucaccugaggcccucaauagaagcugauucuggugccaugcuucuuguacagucugaagaaccauaagucaaguaaaccucuuuuuaaaaaaaaaaauuacccagccucagauauucuuuuauagcaauacuaaauggacuaagaaacauggucuauacagucaauuuuguucauuucuuuaauauuuauugaauauagacaaugugcaaggcacugguuagagauguggagacuaugaaguuggcaaauagagaauaauaauauugagaauccugcaaaguaaccaaauugauuuuagaagcuccuuuaugaaauagacuuuaggcuuuagucuucuuggaucuuuacuuggaaauuuagguauuccugauuuuaacagauucauuuuuuuaagucccagaguagaagaaaauggagguugaacacugaaacauugacuuugaaaacugaacaucucugucaaucccacaaucuguguguuuguguguguguguguguguguguguguguaaggguaugagcuacaacacaaucuugaauugucacuaaaccauuuuuaaaauaauuggucaaccacccaucacaucacuuguauucacaaucccauaaaguuaucagaccagagugauuuuucucuaaucuagauguacauuaaaaugugcaucucauuuaaagauaguuuugguacaucaaagugaauguugauaaacauguaagacaauggaauauaaaguucaaugcauguccugcauucucuccaucuaaccauuuuuguggugccaaugccuauuuucaggugucaaugaugaagaacuggaaaaagauauaguuaaaacaaaaauugcuaaagaaaaaaaugcaugcuuuuuuggauucauuucuacucuuucauaucaauauguuuucuaacauuucuuaagugcugagaaaauuuuccuuuuuguuauccucaauagcagguggcagcugaaauuguucaauuauaugcuuuguuaaaaccuuauaaauaauuuaaauacuauuauuacagucagcuaaagccuaugcucaaauuauauuuucuuuuguuuaaauucccaaauauaucucaccugcuacccuacauucacccccaguaaagucccaaagcccgugggcuagguagggcauuauuguuuuagaauguuaccaaguuggccuagaagaguacuugauuuguugcgacaacuguuguuguucucuagguagaguguugcguaaaggaaacagugauguccaaaggggcuggacuggcagauuggaaguagggagacccaaggucagcauuaugacauggaggauaugaguaaccaccauaaugauuuaagauaucugaacaggguugccagaaaaaauacaugccacacaguuaaauuugaauuucagauaacugauuucuuaaagcauaagcauaccucauacaauuuguuuuauauuuacuauacuuuaaguucugggauacacgugcagaacuugcagguuuguuacauagguauacacgugccuuggugguuugcugcacccaucaaccugucaucuacauugaguauuucuccuaucccuccccuaggcccccaccccucgauaggccccagugugugauauucccuucccuguguccauguguucucauugucuauauuuggggcccacugcuaguaaacauuauucauuguuuaucugaaagucaaauauaacuggacaguuuguauguuuaguuuccaaauguagcagcccuauauaugaagaaagucuucucugcuaaaaaaauuauuuuccugcuuccugaaauucaauuaauuagcauuuucaguucaguuagcaagcgcuuccuuuuaaaagacaaguaucucugggaguacaugagucguuuaugcaucaaugagacuacuuacuucucaauguaaaaugcauuucucacugucaaaguggguuaaucaaucagagagagggcguaagaguucuuuuuuugguugacuagguaggggauggggcuggcugggaccuguuaauuucaguggaagaauacauauggaugaauuacuuuuaguggggauuuucugauggaaugaauuaucaaugugccaggaagagacuauauaaaaagauggaauggggguagagaguguaaggugguacugacagaaaaaacucacucauucuaggauuuuucuugaacaauuaaauacucaugagaggaaccaguguuggguuuuauuuuucaaacauggaugaugguaaauguuaaaaccaguggcaagcauauuuucacauuucuuucauuauuaaaaguauugauguaagauuauccucaaauauaugaguagugcaucuuugcacauuaaggacuccuccuuuauuuuaucacuucgcuuuaacuccguagguccuauacaaaccaaagaaauuaucuuccuuccuuccuuccuucuuuccuuuuuuuuuuuuuuuuuuuuuuuuuuuugauauaggguauugcccugucacacaggcuggagugcagugaugagaucauggcucacuguagccucaaacuucuggccccgagugauacucacaccucaggcuccugaguagcugggaugcauaccagcaugcccagcugauuuuuaaacuuucguacaggcaguaucucucuauguugcccagguggucuugaacuccuggccucaagugauccucuugccucagccucccaaauugcugggaugacaggcaugagccauuguauccagcaagaaagagaaaagaauuuaaacuucuaaagaugaaacugcuacacguggacagccauaacaacaaagagaagaguacucuuaagcauuugugaaagucagaaaccuauaaacuuuugggaaacaaaauaaguauauuuucccuuuaaucuuacaagugaugcaauacacuucuagcaaaagugaaagggcaaauaggaauuuugcaacauugagcucucuuuaagcagaagccaggccauagguucuucacuagucaccagggucuacagccuuuauugucuuuaccagucacuagguaugagacauuuucucauaaaauguaacuacuauacauucgccacaaacuuuaaacccccuuuucaccucccaugguacccagaagagugauagguacuuaauagguccucaaaaauuuucagcuaaugaauaauuguuaauuaaaacuuauacuagaagcaaacucuuaaaacauauucuaaguacuaaagucuaauauuuuauaucuauugguuuauucauauucuuguuuguuaauccuaaucaaauagugcaaaguuuaaauuucauuuuccuaagauuuguuuuaaaauaacacgauuuacccaagugauuucaaaccacaauuacauucuguuuaaauuacuaauauuuuauugcaucacaaucugcaugaaacagaugucaggauauaaugaacuaaccugcauuguauuuuuauuuuugucuccuguggcauaacgauuucauaggaaagagaacuacacagcugacugacugauggggaaaguuacacaauggauagcuuugcagcaacauacuaaugcgguagggagaugcugcagagaggcuagaaauaaaaucauuucuuuccggagcagcacugcuugcugucggcugagacaaaaaagagauuuccuuuuuuuccuuucuuuuuuuugaaaacucacauaacauuaauucuguuaagcacuggauacacggaaagguguuuaccuuagaaaaucauuuagcaauuuuuagaaacuagacauauagcaauuuuaaaucuuuuuaacuaucuaaugaccaaagcagaggguccucacaagagggauuuagaugcuacugaauugaauaaagaaaauauggauacauuuauuguaugccuuauucaguuugagguucauuuugaguuuagaaauagggauauaaaaacaucagggguuaaauagcauggguaaaggacaugaaccaagcugcagagaagaggcugacugccugcuauauuugcaggcauuacucagcacuuuucuuaaaccgauacaucuugcuggcugcauaagcaagacaagacccuuuucccuauggcucaggaaggcagagaagucaacuucagccuugaaaaaggcaaauacuuuagugcaauaaugaaaucaacuaaacgucuugugcuuaauguuucuuuccccacgccacuagaauuguaugcauaaucauucuaugcaacauauugaagaaaccaaaauguuugccacagugugcucaguaauuuuuuuuugaaugaaugaauaacugaauucaugaucaaugccuuauccuaggucaccugcucagugcacgggcuauaggaagggcaaaugucacuguccuucccacccaucucauucuaacacaaguguuaucaucaaacuaaggaaacuaaaacauguagccauaaaacaacuguuuagagcuucauucagauaauauuuuuuucuuuaaaauccaagaauguaauaccaaauuuuaauuaagcgaaggcgucuuuguggagaacuuaaauaauauggcauauugcuuucuguuuaucuaguagagacuacacuuugaaaauauagaccauugcauucauaaaaaucauguggagaucuuuuugaaaacacauaguccaaggucccaccucaagauuuuguuucagagaucuaagguggaccuagaaucuguguuuaaacugcuuguccaggugaucaggauguagcacucauaguuaaugaaugggcaaauuuugagaaacacuguuuuagagaauggucuaggaaaagcauccauuacaaauauaaaaaagcaagcuuuugguaccuaagggacugagucgauucaugcagguauugguuuguugauuaaagaugcauccauaauucaauuaauuuaaauguuagaacaggucauaucuuuuggguuuauuuuuaauuguuucguacagaugaggucucgcuauguugccuaggcuagucuugaacuccuggccucaagugauccuucugccucagcaucgggagucacugggauuaaaggcaugagccaccaugcucagguaggaaaaaaucauuucuuacauggagauuuauuuucucaaccagguaaguuuugugauaagaucauuaaacuuagaauaagaauagucagguucaaaauuugguuguaguccuuaacaaaacugugauauuaaaauaguaccuuggccuugcuuagcuucaauucuaucauuuauaaaaugggaauaauuuuuauaauaacacaugauaggugccaacucagcccucacuccuuuuuugaaauuguccuccauguaacccauacugaaaguauaaacuauguuuauaccaugugacucuuucaccccuuucccauggccacagcuugguagguuuuaugaggacgcugaucacggggcacucaucuauaggcuuaacugaaacaauagaauuugcuuucugggugauguuuaaaugaaguaagagugagugagucagaauguuaugagaagaugcacugcaugaccuagaguugaggaugaggaagcuaugucuggccaugaccaagcagaggauaucggccaaagcagaaaaaaaaaacagaaauaacaguagccaugcaagcauucagaaagaauguaggcuguguugauauguuucuggacuucucauuccaguuuaaucucuuuauggcuuacuuggguuuuggccuaugggauuuucaguugaauucuucuuuuuuuuuuuccuuugagauggagucucacucugucgcccaggcuggagugcaguggcgugaucugggcucacugcaagcuccaccucccagguucacgccauucuccugccucaaccuccugaguagcugggacuacaguugccugccaccacgcccagcuaauuuuuuuauuuuuauuuuuagcagagaugggguuucaccguguuagcuaggauggucucaaccuccugaccucacgauccacccgccucggccucccaaagugcugggauuacaggcgugagccaccaugcauggccugaauucuuauaauaaauaaaccauuuuacuuauacccgcuuaaaugugccuuuauguuuugaauacaaguguucugacaaaagcacaauguaaaaacacugaacauaacauguucuuaacuuuuguuuuaaaacaaaagaaaaaaauggagguucagcaaaguuaaauagcacaaguuaauaaagugaugaccauugucagacaguuuggaggaaguuugagauuuaaauccgggucuaaucuuucacaguucaaugcucuuguuuuaaaaccagaaauucaggcagcaagacugauauuucauuagaaacacuuaugaccccaauauguuuucacauugagaaacugagucauuccacuuuuucaugaaaauagcuaaaagaauccuuaucggucaaaucuuucacacacacacacacacaaaaaugaucuuuaacauuauuucaaguacuuggacaaauaccaaguugggauaccagagaucuauguuaugaaggauggauaaaacaucugauaagaaaaaaagaaagccauuauuauuacaccuuaaauauuaaaugagaaaacaaggaaugacccuuggagaacgacuaauuuugagaauuguauacugauagacguguuggaauggacuacuugcaaacagaaucacugagccacuuaaugaguugagugguugaaaguguccuuuuaaaugaucaauuuagaccccagagaauaucugccagacagaacaaguuuuaguguaguugauaguaaguugugcccagaauauuaaauugagucaaauuuauuuuccacauaaagucacaguuuuauaugucauuauauaaucucuuggcagaaauaaggaauaacauucugaauguugcacuccaaaauucaaagaaucuuaguauaaaaauaucuagcauuuuagauguuucaaaguagggccaaaugcagaaaauaaguuggauaugauaaaaauaccagaaaguucuauucaguuggcaucuuacuagcaguuucaucuucuaauaauuuaguugcuacgcauggaguagaauagaauuuaacaacaacaaaagaucauuaaauaccaaucaaccaaacaaccaaacaccaaaggaccuauuaaacuucaacgaugcucaguuauacucuugaggguacagggcuaucagagaugggcagugugcuccuuuccuguguagucuaugggaucuaucuauguaacccuccaugugcuccuacccuuccccuucagcuguuaaaaacacaaugccaaaaucaggaucaaacaaaaauugcaguuacacuucugaauuuggcaacaucuauuucaccacuccuuuuagaucauuuggucuuuauuauucugcuuuauauuguauuugauuuuguaagucagaucaaauaauuuuuggaaauagaaaacaaacaaauaagcuccccauugcuacaguuuauacccauuuuaaaugauuuaucuuuccauagggauaaaaauucaauuacguacccuccuugugacaaaccuccauacaauugaaggcaguuauuaugucucucuuuaguuuucucuuuuccaagcugaaaaauuuucaauauuuuaacccauagguaugauauaauuauuuguauuccucuuuugcucccuucuaauuucugcccaacuucacuaaucuccuuaggguagaaacuguaauagaauaauggugauaagaacaguaaaaagaugaugucugauuuuuguauacauuucccuuaguacgaauuacugugucaaguuuuuuaguaauauaauaccuuuauuuagccuuugucauuguacaagccaguuugacauuuuaacaaagggggauugaaacaauaaaacugaucuuuaaauauaaaaauaucccaugaucccaugauucuccuguucuuccugcuaucaaucagaaacaacgaugccuguuaaauaaaagagccuuauugguucuaccaaauuugugacuaauuagcuucucugccauccuguuauuuguauaguuuguucuugguucaaaauauacuacacgcuaaccaaacuugacacuagagucucacuugccuugaugggccaauuccuaaagguuucaagguuauucuguuuccuauuuauacauuccucagagcuauuaauaucaguuucacuuaaaauuuauauuuaaugucaauacccagcaugaaaaacuauuaaaugguaauagucuuuagauuaauuuagauaaaugguaauuaauauauuuuuccaggaugucauaaaaucaucauuacuuaccuugaaccacuugaacccuccccuaaaagcaauaugauacagaugaauaauugcagaaaauuaggcccagauuuauucuaaaguuuucaagaauucauaaugucccacuccaguuuuggauucauguuaaauacaugucuuacaaacauucacacuauauucuuuuuaaauuauacaaauguaaguauuuaauaaaaugcaaauucucucaaagaguuauugacuccacagaagacuuuugagagucaaugucuauuguuacuaucaacugacacugaaaguucaauuucuuucauucauaugguaguccauaauucugauaugaaaguuggaaaucagggaugaaaaaucacuuuuuuuuuugguuguuguuacagagucucgcucugucgcccaggcuggagugcaguggugugaauucggcucacugcaagcuccgccucccugguucaaacaauucucugcuucagcuucccgaguagcugggauuacaggcacccaccaccacacccagcuaauuuuuguauuuuuaguagagacaggguuucaccauguuggccaggcuggucuugaacuccugaccucgugauccacccaccucggccucccaaagugcugggauuacaggcgugagccacugcgcccagccugagagaucauguuuuuuauaagaacauauacauguauagauaugcaaauaccuucuuaaagcacagauaagugguauccauuauuuuuuucuugaucaacaugacauuuugcuucaacucaaaagaaaauuacauugaucugacaauuucuuuucacaaggucauaguaauuuuauucuaugcuauucuaggugacuauuaauuuuaauauaugugugacuuuuuguuguuuuuguuuuguuuuuauugaaauuugaagauacugaguuaagaugaaaguccuaaaguucuucaaucacuuuucugaaaucuagaccuccaaauuugcccuuucauaaaguuuaccacuagacuuaacaaaacacucuaaguguucaccauuagugauguaaaucuaaaauacuauauacuucuuucuucuuuguguguguuuuuuuuguuuuuguuuuuguguuuuuggagacggggucaggcucuguugcccgggcuguagugcaguggcaugaucgcggcucacugcaaccuaacucucccagguucaagcaauucuccuggcuuagccucccaaguagcugggacuacaggugcaugccaccacaccuggcuaauuuuuuguauuuuaguagacacaggguuccaccaugucacccaggcuggucuugaacucgugagcucaagcaaucugcccgccuuggccuuccaauguuuucuuuuuuaacaauuuacaaauguacagugauuacacuucguuucuauuuuugaaacuuuuuucaccuuccuuccuagaaggggaaaccuauuaauaguucuagaaaucucaaugccuaccucauccuuuagucuuuauuaauuuguuuuuucuaaaugccaggguuugaaaaucagauaaacaccaucucuagagaucugcuauauguuuaaaaaaaugcuuauacgugagauuaucuagacuucacuuugaaauaagagauauaaaauuauauuugguauguucaaagguacuuguauucaauuaaaaaaaaauagggucuugcccugucacccaggcuggcgugcaguggcaugaucauagcucacugcagccuugaacuacugggcucaagugaucccuuccucagccuccucaguagcuuggaguacagauguguaucaccugaccagcuaauuuuuaaaaauauuuuguagggacagggucucacuuugcugccuagguggaucuugaacuacuagcuucaagcaauccuuccaccuuggucucccaaauuucugggauuacaggcaugagcuaucacaccuagccucuauuugaaguuguauucuagagucuuguagaauuagaaaacuuuuaucuagauaaauagaggucauuguagaaauauuuguaugcaaucugccuuguuuggaugaaguuuucuucucuugcauuuguaacaauucacaagaaauaucuaucugucuaucaaaaucuggcagagacacaaugaaaaaagaaaacuuuaagcuaacaucccugaugaauauagacacaaaaauccucaacaaaauacuagcaaauugaacccagcagcacauccaaaaagcuaauccaccaugaucaaguaggcuuuauuccuaggaugcaagguugguucaacauauacauaucaauagaugugauucaucacauaaacagaacuaaaaacaaaaaaccacaugaucaucuuaauuaagaugcggaaaaggcuuucaauaaaauucaacaucucuucauguuaaaaacccucaacaaauuaggccaaagcauaagagccaucuauaaccaacucacagccaacaucauacugaggaggcaaaagaugaaagcauucucccuaagaacugaaacgaaacaagggugcucacucuuaccacuccuacucaacauaaugcuggaaguccuagccagagcaaccaggcaggagaaagaaauaaaaggcauccaaauacgaagagaggaagucaaacuaucucucuuugaaaaugauaugauuuuauaccuagaaaacaaaaccccacagucucuucccaaaggcuccuagaucaaauaaacaacuucaggaaaguuucaggaugaaaaauuaauguacaaaaaucaguagcauuuccauacaccaauaacauccaagcugagagccaagucaauaaugcaaucucauucacgauagccacgaaaaguauaaaauaccuaguaacacagcuaaccagggagaugaaagaucucuacaacaagaauuaugaaacacugaugaaagaaaucagagauggcacacacaaauagaaaaacauuccaugcucauggguaggaagaauuaauauuguuaaaaugacuaugccacccaaagcaauuuacagauucaaugcuauuucuaucaaacuaccaaugucauuuuucacagaauuagaaaaacuauuugaaaauucauauaaaacccaaaaagauccugacuagccaaagcaauccuaaacaaaaagaacaaugucugaggcaucacaccacccaacuauaauacaagucuacaguaaccaaaacagcauaguacuggcacaaaaacagcuuauccaccacaaucaagugggcuucaucccugggaugcaaggcugguucaauauacgcaaaucaauaaauguaauccagcauauaaacagagccaaagacaaaaaccacaugauuaucucaauagaugcagaaaaagccuuugacaaaauucaacaacccuucaugcuaaaaacucucaauaaauuagguauugaugggacguaucucaaaauaauaagagcuaucuaugacaaacccacagccaauaucauacugaaugggcaaaaacuggaagcauucccuuugaaaacgggcacaaggcagggaugcccucucucaccacuccuauucaacauaguguuggaaguucuggccagggcaauuaggcaggagaaggaaauaaaggguauucaauuaggaaaagaggaagucaaauugucccuguuugcagacgacaugauuguauaucuagaaaaccccauugucucagcccaaaaucuccuuaagcugauaagcaacuucagcaaagucucaggauacaaaaucaauguacaaaaaucacaagcauucuuauacaccaacaacagacaaacagagagccaaaucaugagugaacucccauucacaauugcuucaaagagaauaaaauaccuaggaauccaacuuacaagggaugugaaggaccucuucaaggagaacuacaaaccacugcucaaggaaauaaaagaggauacaaacaaauggaagaacauuccaugcucaugggugggaagaaucaauaucgugaaaauggccauacugcccaagguaauuuacagauucaaugccauccccaucaagcuaccaaugccuuucuucacagaauuggaaaaaacuacuuuaaaguucauauggaaccaaaaaagagcccgcaucgccaaggcaauccuaagccaaaagaacaaagcuggaggcaucacacuaccugacuucaaacuauacuacaaggcuacaguaacccaaacagcaugguacugguaccaaaacagagauauagaucaauggaacagaacagagcccucagaaauaacgccacauaucuacaaccaucugaucuuugacaaaccugagaaaaacaagcaauggggaaaggauucccuauuuaauaaauggugcugggaaaacuggcuagccauauguagaaagcugaaacuggaucccuuccuuacaccuuauacaaaaaucaauucaagauggauuaaagauuuaaacguuagaccuaaaaccauaaaaacccuagaagaaaaccuaggcauuaccauucaggacauaggcaugggcaaggaccucauguccaaaacaccaaaagcaauggcaacaaaagacaaaauugacaaaugggaucuaauuaaacuaaagagcuucugcacagcaaaagaacuaccaucagagugaacaggcaaccuacaaaaugggagaaaauuuucacaaccuacucaucugacaaagggcuaauauccagaaucuacaaugaacucaaacaaauuuacaagaaaaaaacaaccccaucaaaaagugggcaaaggacaugaacagacacuucucaaaagaagacauuuaugcagccaaaaaacacaugaaaaaaugcucaucaucacuggccaucagagaaaugcaaaucaaaaccacaaugagauaccaucucacaccaguuagaauggcaaucauuaaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcauuauucacaauagcaaagacuuggaaccaacccaaauguccaacaaugauagacuggauuaagaaaauguggcacauauacacuauggaauacuaugcagccauaaaaaaugaugaguucauguccuuuguagggacauggaugcaauuggaaaucaucauucucuguaaacuaucgcaagaacaaaaaaccaaacaccgcauauucucacucauaggugggaauugaacaaugagaucacauggacacaggaaggggaauaucacacucuggggacuguggugggguggggggaggggggagggauagcauugggagauauaccuaaugcuggaugacgaguuagugggugcagcgcaccagcauggcacauguauacauauguaacuaaccugcacaaugugcacauguacccuaaaacuuaaaguauaauuaaaaaaaaaaaaaaacagacacauagaccaaugaaacagaagagagaacccagaaauaaagucacacacauacgacguucugaucuugaacacaaucgauaauagcaagcaaggcagaaaagacucccuguuaaauaaacugugcugggauaacuggcuaaccauacgcagaagauugaaacuggaccccuuccuuucaccauauacaaaaaucaguucaagauggauuaaagacuuaaauguaagaccuaaaacucuaaacccuagaagaaaacuaagaaauaccucgauuaaggccuuggcaaagauuucaugacaaagucuccaaaagcaauugcaacaaaaccaaaaauagacaagugggaccuaauuaaaauaaagagcaucugcacaacaaaaacaaaacuaucaauagaguaaacagacaaccagcagaaugggagaaaauauuugcaaaccaugcauaugaugaaggucuaauauccaguaucuauaaggaacuuacauaaaucaacaagugaaaaacaaccccauuuaaaaaugggcaaagaauuaaaaagacaguucucaaaagaauacauacacgugaccaacaagcauaugaaaaaaugcucaacaucaugaaucauuagagaaaugaaaaucaaaaccacaaugagauaccaucucacaccagucagaaugacaauuuuuaaaaagucaugggcggggcgcggugacucgcgccugcaaucccagcacuuugggagguugaggcgggcggaucacgaggucaggauaucgagaccauccugacuaacacggugaaaccccauuucuacuaaaaauacaaaaaauuagccgggugugguggugggcgccuguagucccagcuacucaggaggcugaggcaggagaauggcgugaacccaggaggcggagcuuggagugagccgagaucgcuccacagcacuccauuccagccugggcgacagaguaagauuacaucucaaaaaaaaaaaaaagaaaaaaaagaaaaaaaaaaagucagaaaauaacagauguuggcaagguuguggggaaaagggaacacuuauacacugguggugagaauggauauuaguucagccacuguggaaggcaguuugaagauuucucagaauaaaugaaaacagaacuaccauuugacccagcaaucccaauacuggguauauauccaaaggacuauaaaucauucuaccaaaaagacacaugcacgcauauguucauugcagcacuauucacaauagcaauggcaugcaaucaaccuagauguccauuaauggcugacuggauaaagaaaaugugguacauauaugcuagggaacauuacacagccauaaauaagaacaaaagcauguccuuugaagcaacaugggugcuucagagaaaauaccauucaacaaaguuucaguaauauucgagcuauuuuguggauaaugcacaacuuuuguaccuuaaggcauuguucaauucuguuuaagaauaaauuguuuuugagcugccuauuagauuucaagccugacuuuagauuugggagauauauauauauauauaugacgguuucuguucuagaggagcagacagucuguuaggccagacacaguugaauagcaauauauuauaauauugaggaaguaggcugggcgcgguggcucacgccuguaaucccagcacuuugggaagccaaggagggcggaucaccugaggccaggagcucaagaccagucuggccaacauggcaaaaccuggucuuuacugaaaacacaaaauuuagccgggcaugguggcaggcaccuguggucccagcuacucgggagacugaggcaggagaaucacuugaacccgggagguggagguugcagugagccgaguucgcaccgcugcacuccagccugggugacaaagcaagacucugucuuaaauaaauaaauaaauaaauaaauaaauaaauaaauaaauaaauacugaggaaguauaacaauaaguuaucuuugagacacggaggaagcacagaagaggauauaaucacuucuuuugggauaugaggagggggaaaaauguuaagagaagcuuccuaaguaggugagagcugaaauggguuuuguaaaauaaaaggaaauucaccaggaagauaaagguaaaggacugaggacaugugaggcauguaaaauuaauaugaucuuuuagucacuuagaaaaaauaccauaaagaacacuaauaguguuuaaaagcaucuacccagugccaagaacugcauuauguauuggugaacauaacuuuagacuuuaccauacaacgugaaaauauauauuauuaucacuauuuuacagaugaagcaauaaaagucagaaaaaauguagcuaauuaaagugauacuguguauagcuagagcaguguauagcuagagcugauuugucugacucuagcccuaguuucuuuccauuauaucaauuuccuggaaauguaucucuguucauggcauagugccugacacuaugcuuauuaauaucuuuugaauaaaagaaccacugagugauuugaaauaaaacuaaauuuaguuaguuaauuuuauuggugguauauagagauaguaggaaaaauaauugaaaagagacauaaacagauuugccaauacuuucuaagaaaaauuauggaacuagaguuuagucaaaaugaaugcuuucauuguuagaauucaacuuuaaucuuugcagaauacaaacaaagacccauuuucuagaagaaguaacagggaagagagaguaagaaagagauaaugaugaacauugucuaauguuacagcauaaucuaguaagguaagaacagaagagaguucauugacuuaccaacauaguugucccuaaucaccucugugaaccuagagugcuacgauauaauaaugauuguggugguuuaaaaaguaaauggggcugggcaugguggcucacaucuguaaucccaucacuuuggaaggcugaggcagguguauugcuugagcucacaagcucgacaccagccugggcaacauggcaaaaccccgucucuacaaaaaauacaaaaauuaaccaggcaugguggugcguuuguguaguuccagcuacuuggaaggcugagguggggggauugcuugagccugggaaguggaggcugcaugagccaagguggcaccacugcacuccaaccugcgugacagagccagaucuugucucaaaaaaauaaaaaaauuaagguacauuuuauauaugagacuaugagaccgccaaaugauauuucucagccaacagccuucacagacauuugucuuagagccgauuuggcuacuuuguguugccaguaugcuguuguaagaaagcacaggaaugcuuguaaagaagaaaagaauugguaucaugguccugaaaaaaguuauuuccucaaggaauaaaaauagcaaaagaaaugacguaauuucucagcuucugauauguuucaaauaaccucagugaaguccuaggggaaauagcuuauaucauaugucuuacuccuuaggauuuuugcuauagaggaaaaagugugaaguuuucuuaauuuaauguuuuauacauauuugcuugcuguaccuggaccuuacaaaguggauacucuuuagaaagugaugaauauuuucacuuuuaaaagguuucagaguuuaaaaagguuaaaaagaaucauucauaaaaguuuaaaaacaacuucaucaaggguuucccuuuugccaaguuauaaguuuaaaaugagagaaugaauuugguuauuaacaggguuaccaccaggccugaauguaaauuaaaccuuugccaauagaagugaaacagaaagaaucaaccaacaauuuuaugaauuacagaccucauacacauuaaaacuucuacauauguaguuaugcuucagugaaacccuuuacauuguaguuaugcuucagugaaacccuuuauauuaaaauaaucaucacguauuugaccauaugaaaauaguuuacaucuaccacauuugguuuaucuuggccaaaaacaauuaauccuuagaaaaucuacuauaugaauaacucaauaauaaucaaagcauuugaauuagaaauaggaucaaacacacuuuuuugaaugaaugccuaauuuuuauuucucaguggaaaugcuagagcauauccaauauucacuagugaaaaaggcuauuuuccaugaagcccaugagaagaugacauaaguuaaacuuguccaauuccuuuucagggauagcaucaagaaauugucuuuaccccuauaaacugaagcauuugaaaaucaguaauauuaacugagcaaaauaacuuguggcaacagguaucagucugggacacaaucaagauacagaaaccgggccgggcgcgguggcucacgccuguaaucccagcacuuugggaggccgaggcggguggaucacgaggucaggagaucgagaccauccuggcuaacacggugaaaacccgucucuacuaaaaauacaaaaaaugagccgggcuggguggcaagugccuguagucccagcuacucaggaggcuaaggcaggagaauggcgugaaccuggaaagcggagcuugcagugagcccagauugcgccacugugcuccagccugggcgauagagcgagacuccgucucaaaacaaaaacaaaaacaaacaaaaaaagauacagaaaccacaugcuaauuuaaacagagaaaguuuaauauaugaagaauuauuaaguacugauaggagaguaaccauaaagauguaagagaaucuaaaggguauccuggagcuaagguagaggacucaaagaagagugaacuggaaggauuucccaucccaagguugggguccaaacuucauugggaaaagugugguggaagcccucuuucucuacagcagaauaguuugcugggguguccuggccggagcucugguccacaguugggcuacuguugggcaagcagaaacaauucuuuagggcacaggugagcuaagguuggugggugggccuucagaaggagugcggcacugaagugaggaugugucuguguuggcagugugcggugucagugcugggagaacuguggcaaaguggucacuaggcccuuauauagaggcugugaagucaccaacagacugccccaucugggcauguggcuggggaaaaacaccaccagaugucauuacacaagcacguugccaaugguccauugcuaaugguccacauugcuaaugaucgaaguaaaaucaaaauguagcauuagaaccaggaagagaagccccuuccuccugcagugacccuucacugcccucuacugacaaagaguaacguuaugcucacggucuaagaaaaaugcuuuaagugcccaauacacuauuucugguuagcuaccaaagagagcuaagaggcaauacacugguaacugucaugucuuguacaugaauaucauuauucauguuuuuuuaaaaucacagacuauacuucuuaacagcuacauacauuuuauuuauauucaucagaaacuuacugcuuauucuuugcccuuaacuacuuguauagaccaacauggaaccaaauuugcugucauauaggcuguugaucucuucauccacuagcacuuuucugaaacaaaaagcaaguaaucuucgaauucacauaagcauuuaucugcaacucugguguuacuugacgacugacuucuaccucccaguauauuugcuugugaauaugucuuguuuuuugcuuuaguccauaagcaccuugagagcagcauuuaccuuugcauucuucacuguaucgugcaaaguacuuuacccauaacagucacacaauaguugcugaauuaauuaauaaaauauuuggaauaacaacaccuaagagugagagguuacaaaacacgauaguucaaaauucaacaguuauaaaaaaaaaucaaaaguuaaaauacagaauauguuacaguauugaacauuguaugguaaauguaauuuacuggaaaguaugaauuuuauagugaucacauacuuuucuuaauauuuagauaucugacacauguaaaguagcaauaguucuuauucugaaccauucuugaauaaauaagaagagaacacaacuuggcuaacaauuuuuaucaauucagcuuugggugcuaacauaauuuaauugggaaagaauaaucauuucagcaacuaguacuagaaaaaccagauauccacaugcaaaaggaaggauuugaaacuguggauaacaauguacaaagauuaauucaaaauuaaucauaaauuuaaacguaagaacuaaaacuauaauucuuuaaaaauaugaguaaauauggugcacauacauaagguaauaauuucuuggcugcaacaccaaaugcauaaguggucaaaagagaacauugauaaauuguacuucauaaaaaaucauuugcccuucaaaagacaacaucaaaaaaugaagacaacccacagauugaaagaacguauuugcaaaucauauaucugauaagcgauuguaucuggcauauauauauauauuuuaaaacucuuacaagucaauaauaaaaaaccccaaagaaccuaacuauaaaaauaggcagaagauuuggguagauacuuguccaaagaagauaaaugacuaaucaacgagcacaucagaugcucaacaucauuaaucaugaaggaaaugcaaauaaaaaacccaaugagacaucacgucacacacacuggaaugacuauaauaauaauaaaaaaaacagauaaucacaaguguugggaaggauauagagaaacuggaacccucauauauuguuaguaggaauguaaaaugguacagccauuuggaaauacacuggcagugucuuacaauguuaaacauagauucauuauaugacccaguaauuucauuccuagguaucuaaucaagguaaaugaaaacauguauccauaugaagacuuauauggacauguucauagcagccuuauuaacaauagcccaaaaguggaaagcacccaaauguccauuagcugguaaauggauaaacaaaaugugguauauccauauaagggaguaugauuggucaauuaaaaugaaugaauacugaaacaugcuguuaggugagugaaucucaaagauauuauguuaagugaaagaagaaagucacaaaagaugacacauugcaugauucuauucauauaaaaugucuagaauaagcaaauguacagagacagcaaauagugauugccuaggacugggagugggaauagagagugacuacaagugggcaucaaguuucuuuuuagcucaauggaaauguucuaaaaugagauuguaaugauugcugcacaacucuauaaauauacaaaaaagcacugaacuaacaaggagcuaaaacuacaaugauaaucauguaagcagugauaauuauuugauucccuucuuuuucuguuugaaucagaaugccuugacaauuuuuuauucuuuucucuucuauaggauuucaaggaguuuagaacuuuacagaaauaauaacaaaaauuacagcauuugauuaauaaauacaucuuuuaguaauuuucuuuuugccuaaagucaagaauaauuguucaucuuaguauguuuauuaacuacucuugguguuauguugggcguuauaauaaagaaaaaucuuuguuucaaaauuuagguuggaauuuuggauccuacucugacuaacuagguacacuacugaauuuacaucaagauaacaguacagauagauaagaacauugauuuccuuaagaucaguaauuugaagcuuaaacauaguaugcaacacauugagagucucaaagaaguaacaagugccaucuuuagaaaauauuuuauauacuugguguggucuuaucauaagaaguauauacauacauaccuugacauauuguacuuugcuuuauugugcuucacagauacaguuuuucacaaauugaaaguuuguggcaacccuacauccagcaagucaauuuuggugccauuuuuccaacagcaugugcucacuucguguaucugugucacauuuugguaauucuugcaauauuucaaacuuuuucacuauuauuauaucuguuauggugaccugugaucaguaauauuuaaugucacuuuaguaauugcuuggggauggcaagaacugcacccaaauaagagugaacuuaauugguguuacgucugcucugacugcuccaccaacaugcuguucccgucucucuuccucuccuugggcuucccaguuccuugagacacaagaauauugaaauuauuccaaucaauaacccuacuaugugggugguggggaggugggaaugauuaauggguauaaaaauguaguuagauagaauaagauccagaaauguaguuaaauagaauaagaucuaguaacacaacaguuaucacagucaacaauaauuuauucuauauugaaaaauagcuaaaagaguauaauuggaauguuuguaacacaaaguaaugauaaaugcuugaggggacacauaccccauuuacucucaugugauuauugcauaugauacgccuguaucaaaacaucucauguaacccauaaagguauacaccuacuauguagccauacaaauaaaaaaaauuuuuuuuuaaucccuacaauggccuuuaaguguucaagucaaaggaagaauugaauguuucucacuuuaaauuaaaagcuagaaauaauuaagcuuugugaggaagacauguugaaaccuagauaggccaaaugcuaggccucaugaaccaaacaguuagccgaguugugaaugaaaaagaaauauucuuaaauauucuugaaggaaauuaaaagugcuacuccagugaacacaaaaaugauaagaaaguaaaauggcuuuauugcugauaugaagaaagucugaacaaaagauugaaccagccauaacauucccuugagccaaagccuaauucagagcaaggcucuaacucucuugaacucugugaaggcugagagagguaagaaagcuacagaagaaaaguuugaaguuagcagaguuugguuuaugagguuuaaggaaagaagcugccuccauaaaauuaaagugcaagguuaagcaguagguacugguguagaagcugcagcaaguuauccagaagaucuagcuaagaucauugauaugguuuggcuauguccccacccaaaucucaucuugaauuguagcucccauaauucccacaugucaugggaggaacccagugggagguaauugaaucaugggggcagguccuucucaugcugaucuugugguagugaauaagucucaggagaucugaugguuuuauaaaggggaguugcucuacacaaacuuucuuugccugccaccauguaaaacaucccuuugcuccuccuucaucuuccaccaugauuguuugaggccucccuagccauguggaacugugaguccguuaaacugcuuuccuuuauaaauuagccagucucggguaugucuuuauuaguagggugagaacagacuaauacaaucauugaugaaggugacuacacuaaacaacagauuuucaauauagaugaaacagccuuauauuaaaagaagaugccaucuaggacuuucauagcuagagaggagaagucaaugcuuggcuuuaaagcuucacagaauagguucagucucuuguuaggagcuaaugucaccagugacuuuaaguugaagccaauuuucauuuacuagucaaaaaaauccuagggcccuuaagaaguaugcuaaauauacucugccugugcucuauaaguagaacagcaaagccugaauggcagcacaucuguuuacagcaugcuuuauugaauguuuuaagccugcuauugagaccuacugcucagaaaaaaaaaaaagauuccauucaaaauauuaccgcugacugacaauguugcaaagagcucugauggagauguacaaggagauuaauguuauuuucaugccugauagcacaacacgcacucugcagcucauggauugaggaauaauuuuuauuuucaagucuuauuauuuaagacauacauuuuauaagacuauagcugcuauagagagugauuccucugauggaucugagcaaaguaaauugaaaaucaucuggauaaaauucaccauccuagaucccauuaagaacauuuguaauucaugggaggagguaaaaauauccauaugaacaggaguuuggaagaaaucgauuccaacuuucauggaugacuuugagggguacaagauucaguggaagaaguaacuguaaauguggcagaaauagcaagagaacuagaauuagaaugcagccugaagaugugacugaauugcugcaaugucaugauaaaaccuuaagagaggaggaguugcuucuuauagacgagcaaagaaagugauuucuugaaauagaaccuacuccuggugaagaugcugaggacauuguugaaaugacaaaaaaggauuuagauauuacauaaauuuauuugauaaagcaguggcagggcuugaaagcauugacuccaauuuugaaacaaguuauacuguggguaaaaugcuaucaaacagcaucacaugcuacagaggaaucuuuugugaaaggaagaucaaucaacguggcaaacuucauuguuguuuuauuguaagaaauugucacagucaucucaaccuucagcaacuaccacccugaucagucagcauccaucaacaucaaagcgagacucuccaccagcaaaaagauuauaugacucacugaaggcucagaugacuguuagcauuuuuuagcaauaaagcauuuuuaaauuaagguaugcacuuuuuuucaacauaauacuaucacauaccuaauagacuauaguaugguguaaacauaacuuuuauaugcacugggaaaucaaaacacuugugugacucacuuuauugcaauauuggcuuuuuuguggugggcuggaaccaaauguguaauaucucugaggugugccuguauuuggucuuaguucuugcugccuggcacagagcuccuauaacccuuguuauuuccugauuaauauuggugauagcagcaucuuucuuauauuuggccuuaguuccauuuucugacauaagagcuucuauaaucuuuagaaucucuggagugccuuuuuguaugcuaaugagaugacaaguggcugagggccccuacauagcuucaggauugaggcuagucacuagaaagaccugcaucugcaagggaugggcuagggguugaagauuaagcuaaucaccaauggucaaugauuuaaucaauuaugccuacauaaugagaccuccauaaaaacucuaaauuauggaguuuggauagcuucuccuacccuauacuuucugcuauaugucucuuccaggcuguuccuuuacaauaaacuggaaauaguaagcucuuaaauucugugagcuguuguagcacauuauugaacuggaggauuuauagcuggucagucagaaguuccagaggccugggucuugcaacugauguuugaaguggggcaguuuugugagacugagccauugacuugugguaucugaggauaaugccaaguuauuauugaauugaauugugggacacucaacuggcugucagacaauugaguggugagggaaaaacagaaacaaaaacaaaaacaaaacgacccacauauuugaugucagaaguggugugguuaaaacaguaguacuuggcuuuuuuuuaaauuuagaaucuaaguacuuaagaguagauaucuuggcaccuaguauuaaauauacuagguucucaauacauauuguuaaaugaaugacuaguaaaugaaaaaagaaugagaaaauuauuucuugcucugaccaacuuccugacuguuuuacucuaagucccaauaaauaugaauauuaccauaauagcuaaaagaaugcuauugauuaaaauguuuccugucauuugucuuuuagcuugaacaaccgauauauauacuaaucauaaauauaaaauaacaggugugcuauaauuuuaaacagcuacuuuuaaaguuuugaaauuguagauuacccucugagaauuagaugcauacaccaagguuauugcuagagggcaagaauuacuacacuuuaagauaaaacacaauggagacuuggaaggguaguaggugcaagguggguggaugauaggagguugcuugguggauacaaugcacauugcuccagugauggaugcacugaaggccguaacuucaccaaaaugcaauauaucaauguagcaaaauugcacuuguaccccacaaauauacaaaaauuuuuaaaauugauaaaauaauaauuaaaauuguuuuucacacucuaauguuaccuugguuugagauauaaugugauccuuggaucucauggagaauauuaauaauucucuuucuuagauaauaacaaaccuguaacuauucauauuugaaaaauaaauaagaacuuuaaaacuguuaccacuuccuuaccucccuuccagcuaucauauuauuuaguaugcucaucaaagacagauuuuaauguauauuuuaaauuucuuaaaaaguuuguaucaagaacucuaagaagaaaguuguuuucugcuguaaagugguagaaaaaucagaaauuaguuaaacaaugcaaugauuuucagagaguuguucaauguuaauauauaaauuauuuugugccuguuucugaaagcaggaaaacaucugagaguauuaaagaacuagcccaaauggguucauuuugaacaaaugaugagagaaggagagagugaaugaaaguagugagccaagcucuuugugugauuccuacucccagugaggaccagaagggagaaucaaaaagaaagagaacaagcccagugcaagaaaccaugcacuggaauuguuuccuucagauuuaaguguuaauugacuauaucuuguguguacugcauggacuuuguuggccuucuguuuuccuuaaucaagaaaacccuaaguuuugggaucuguuuauacaacagaugaucuuuuggcuauuaauaaaaauguaaaauucuugguauuuuuaauguguuauuuaaauuuacuucaaaaguaaugaugcaacuaaaaugaaauaaaauuuccaugauuaucagaauaauuaaauaaauguaaaacuacaaggaaauauuaugaagccauuaauauuauacuuuugaacuauucugauggcauuaaaaaauguuuaagauguaauaugugcuacaaaauugaaaacaccauaggaaucccauuauucaaacaggaagagaaaugguuuagagcaaaauauuaacauguuaaaagcaauauuuuauuauuguggggaaaaucacauagauuaugagaucacaaauauuauuuucuucuuuaugcuuuucuaaauauucuguuuucuauaauaucaaugcauuccauaacuauaaaauauaguacuugaauaauuugcuaauaauuagacucaagcaaagaccaaagaaugccucaaaaugagcuaggcacgguagcucacgccuguaacuuuggaaggucgaaacagguggaucaccugaggucaggaguucaagaccagccuggucaacaugaugaaaccccaucucuacuaaaaauacaaaaaauuagcugggcaugguggcgcaugcuuguaguccccgccacuuggggggcugagacaggagaauugcuugaacccaggaaguggagguugcagugagccgagauugcuucauugcacuccagcagccugggaaacaagagcgaaacuccgucuaaaacaaacaaacaaaaaagaauaccucaaaaugauaaaaggagaaguaaucaaauuucucagacacugaauaaguaaaaacagcuaacaguaauaauuugaagaaaaaaugcauucagaauuacuuugaaaagcagugcuuaaucauaguauauauaaguaguucaauacucauaguauauaugaguuuagaauaggaguuugggacuugcauaagaaauaaaagaauuauuuaaauuauuauaugcuucaagcauauuucuacaaaaacaguauuugcgaaagcauccuauaaaauguaaaacugucagguauuaauauuaaagguaacccuaaaaauguuuuuguuuuguuucauuuucauuuaacaauuucuauugagaaccuagacaccgaaaacggaaguaggcaguggcaaugagacuuagucacaucagacaauaugcugcaccauauugcaaagaagguacaguauagcagaggaagacaggggaauaagcacaauaaagugcagugggagagaugauagaaauguauacaggaccuaggcacaacacaaaaggaaauuaaucauacuuggggaagaagaggucguggcuauucaccaaauaaagaagcaguagcaaagaccuagagauagaaacagcuuuaggucuucacagaaaugcaauuaguucuuucugaaggacuaaugguaagguagaucgaccaugggguaagaaauaaaccuggacagcucaugaaagccagccaugcugaauaacugaauagcuuuuacuccaggauauaacuuacagucuuaaaaaguagagauguggcccacauguuugaaaggucacuggugguaguauggagaucagguucuaauugagggaagggagugggugaacauuuagaaaaagaccaauagaaacuucuuacauugguuuaggugaggaaagaugaaaguccuaacaagaguauuagaacauuuauauuuuauaauccucugauuugcuuugcaacaauuuuuacucacuuuauacagaacuuacugaacuaaacugauaugugcagcucauauuacaguaaugaaaaauguacuaacuuguguaaugugacaaauaucuucucuauccugcauaauucugggggacucaauuaucugcauuauaauaaucucaacuaauacagugcaacaaacuuaaucugaauaauuuaucagauaaucugauaauucaucagauucagugucccagaaucugaugaauuaucaaauucaucagauucagugucccagaaucugaugaauuaucaaauucauccuugucauaauuuuuuugucucaagacuccuuuugauuguuaauauuauugaggaaacaaaaaauucuucuuuauaaugaguucaauguauugccauuuaccauguuagaaagcagaaaaaucacaagcacaucaauuaauaaauuuauaaauuauaaucauaaaucacaugucaacaaaauaaauuucaagugaaaauaaccauauuucuaaaagaaaaagaucuaaugggaugagugcuuggcuaaguuaugcaggucuucaaaauauuggaagauuucauuauucaucuguuaauauuaccacuaaucacaucagaaacccuguaaguuuugagaagcuguugagcucaugguggcagaugcaucuuuuucaaaauaauaauuuucucuugaaaggccaaauuuugucacugacaacaaauauugucaaauguauuuuuaaaaugacagucuccauuuauuuucaaaaauuugucuuuucaauaucuguuugaauaaucacaauuugucucucagucauuuuuucaaauaaaaauaguauucuauggaaguacagcuaguuuagcuugcaacucaaacaacuacacaagugcuuuaccuuaagacaaccagcauuauuguugauauacagcagauguuaaucauguauacuuuccauuucuucauguauacugaauauuaaaaauauguguacuuaaugguauagauuaaauaaaauuaauuucuaguguuucgucaaagacauucuuuuagugcaacuggcuuuaauuuuauucauuuauuuauuuacuuauuuuuacugggaaugaauuacagugaagaauacaaugacaguauaguuuguugucacugucuugauaaguguuaaggcuagggguuucauuguucuuccaaaugucaacacagugaaaaagguaaauaauguuuuuguaucauuaugaaaauaguuuggaccugaugaaucauuuaaaaagucucaagggaaugcaagagcaucuguggaccacauuuugaaaauaacugcuaaaaucacauuaagaauuuuuuggccgggcacggagguucaugccuguaaucccagcacuuugggaggccaaggcaggcggaucacgagaucaggaguucagccuggccaacauagaaaaauuagcugggugugguagugugcgccuguaaucccagcuacucaggaggcugaggcaggagaaucgcuugaacccaggaggcggagauugcagugagccgagauccugccauugcacuccagccugggcaauagagugagacucugucucaaaaaaaaaaauuuuuuuuuugauuuuuuggauuauauucuauaugcauuaaagacuaugaacauucugagaacaugacugugaaaaguuuuuuuuauauguuacugaauggaaggaggguuagaaaucagcagaguaugcaaaaacagaguaaaacaaaaugccuaggaaugaaaaaaaaaagagagagagagagagagagucagggagaguaagauaaaguuuggucccagagaagauacagucaagauuccacuuuuugcuauuccacagagauuucaggaagaaaaaucacacuccuauuuucuuuuucuuugcuuacugauuucuauuuaguuucuuuuuuuuuuuuuuuuuuuuuuuuuuuugagaaagcgucucacucucuugcgcaggcuggagugcaguggcuagauucuucuugaguaugcucaaacuuccuuuuuggaaugucuuccaaaggcacucuugccuucauuuguacaaguugauugacccuuuaaaggccuuaaauauuauugugcgaccucacagacuccucaaaucaccugaaaccugaaaugcugaggcccagguggcacugaaaugaugguauucuagaccugacaccggacuguuuucuccuugguuuugucccaacacacugacauacauagcccaaaauacuacuggccuuuuuaaguggcauaucacauuccaggguaauaucaaaacugcugccugguagcauuugugaagucucaaaguaacucuuuccaggauuuucaaauccacugaauuucuuagauugaaauauguaugugacagaauucucuuagcuuucuuuccucuaugaauauguaauuggaaacucugagauccgguuucucaucuuuauuggauuuuuucuuuaaucuuaaaauuaugaauauuugcuuuacaauaaucuagauaaggaguccccaaccuuuuuggcaccagggacugguuuuguggaagacaguuguuccacggacauuguggggagugggggcuggcauuagaaucucauaaggagcacacaaccuagauccugugcaugcacaguucacaauaggguuugugcuccuaugagaaucuaaugccgccacugaucugacaggaggcggagcucaggcuguaaugcucccuggcccacugcucaccuccuacugugcgacccaguuccuaacaggccagggaccaguacugguccguggcccaggguuuggggacccuuaaucugauguuacuaaguuacaucauuaauaaucuauuucuccucacacagauuucuuuccucacauccucaacacauauaauuucacaucuccaaaugcagcauucccuaauaauuacccuucuuacuccauucugccaccucuggcucauuuucacuugccauuccauuugauaaucuaguaacuucauuuugccaacuugaugaauuugguucuaaguaguuuaaaaauuuaaggacauacuaugucaguauuuacaggugcuucuuauuuauucuucaguauucucaaauguucaauuugaggucaaguuuugcuaaaaacaacucauugcaaauaguagauguuuuauaaauauaagauaaauuucuuaaaauucgugcugaguucuaaagagaaaacuuagguuaccaaguaacaugauuuucagaacaccaccaauuugcuauuucaagucuaauuuuauauuagaccgauucccaaagcuuuuccauuguuacaaaauuuucaaaauacuguacuuuuauuauacaagguuuguggccuaguuuuauuaauauuccaaaagacaaaauauucaaacauucaauuguuucaucaauaauuuaaacuaaauuuacuauuuugauuaaagauacaaugaguaucuuugcaugaaauagauuacuaaauucuauuugaaaacuaauguacacuuuuauucuaguuuuuaaggcaacauauguuuauuuugaacuuuauuuuaagaaaacauaccaaaacaaugccaaauuguuugguaagaaacaauaccaaagcauuugaaaaaauaaauuauuaacaauaauaauuuuguuguguaaaauugugaguuauuucaucauuuuauuaauuuauauuucccuuuugcuuuauguauuacuuuugcuuuauguauuacuuuugucauaagaaaaauaagauguaauauucuauuuaaauuuuuuuuuuguuuuaugcacuuuauguuccuuuuuuauguacuuuauguuccuuuuccuuuauguauuacuuuuauuauaagaaaaaauaagauguaauauucuauuuuuaaaacaaaaacuuuauaaagaagaaaacagaaauccuaauucuauaaaccagagauaacuauuauauuaucuucagggcuuuuucuaaggaaaaacauguuuguuuuuuuuccguaauuggggccauccuagauauauauguuuguaagguacuuuuuaauauacuauuauaaccugggcaauuuuauauagaauuaaauauucauugaaacauuauguuuaaugguacuauaauauuucaucauuugccuagacuaugauuuauuuagccauucuuucaaccuuccagcauuguguauguagacuguuuucuuuuuucuuuucucuuuuuuuuuuuuuuuuuuuuuuuuuuuugagacagagucuugcucugucauccagacgccaggccggagugcaguggcaugaucucggcuugcugcaaccuccaccucccggguucaagugacucuccuggcucagccuccugaguagcugggacugcaggugcacaccaccaugccuggcuaauuuuuuuguauuuuuaguagagacgggguuucaccauguuggccaggcuggucccaaacuccugaccucaggugaucugcccaccuuggccuuccaaagugcuggaauuacagguuugagccacuguaucuggccuauguagacuauuaaucucuccaauuuuguuuggguugaauuaguuuuccuauauggggauaguuugguggaaaugucagucaaggaacuguuaguuaaguuuacucuuaacuaaaaggaucagauucaugacccaaacuugaccaaccagauguuuacuuccuggaauuuugguguuaaacaugaaugucaggaaaaaaaagaaaaaaaaaaaaaaagaaaaagaaagaaagacaaagagccugaaagcaguugagcugauucauucuagauuacagcaccuuacagaaaccaccaaaagucuaccaacugggcuaucugcucuuauaguuuucucugcuccuggcauuuuucagucuagauuguagcuaucccuuaacucugugaacuauaauaucuuuugaagacauugcuuuuauacuuaaauuaaccugagucaguuucaguuacuuauuguaauacuuuaauuuuuuuuuaccaauuccccaugaauuccuaauuuuauauccuuuucugucacuuuccucacugaaauaaaugagcaucuuaauucuuaucacagaucaugaauguaaaugugacauuauaggcacagcaguggaaucagugucaccaucauuuuauuucugcccccacuuuguuagucaucaugccuguaauuacaaaccuaauuaauugccuuuauuagaaucuuaacacauacacagauaacucauuauuauccaguaggaggaggguaugaauaaugaaaauccaucauuuauaaaauaaccacaacaguuucaucaacaacaaaaaaauaucaauuuaaccuucuuugcuuaugauuuuaguagucauaaguauugccagagacaacuguuagaggcugaauuguauccuccccaaauccauauguuggagucucaaacuccgguaccucagaaugugacuguguuaggaguuagagccuuugaagaagugguuuagugaaaugagacuuuuagggugaaccacaauccaauaugacuuguguccuuaaaagaagaugaaauuuagacagaaaagagacaccaggaaugcacaugcacagaggaaaagacagacaucagcaagccaaggagacgggcuuuagaagacaccaaacuucccaguaccuuguucuuggacuucgagccuccagaacugugauaaauacuguuauuuaagccacccugucugugguacuuugucaugguagcccaaguuaacuaauacagaaaccaacccuauuugaauggcacaccucuaucucaaguucaguaguuuccccaaugguaucugugaaacaaaagcauacuagcaacauauauuacaaagaacauggauaauauuuguguaacuuugggaaagcaugugcaauacaguaaauauguuucuuuggaauaaauauaaccuuucccuggaaauauuugcucauuaucuccuuaaauuuucaguggagucacaaaugaauauguuuccaauaaugagaagaaacauuuuguugugaaguuagaucaauaaaguguuuaauaguuaaggguauauggaucaguuuucugauucuuuaaaguuauguggauucucaagaacaaagaaucucacugaccuuuucuuaaaagauauaucccuaguacccacuguaagaaauaauugaugcuaaaaucauaaacgcauggacaacaauguuaauaagacaauucaccggggaaagaauugucuuuucaacacguggugcugggacaacuagauaugaacaaacaaaagaguaaugcugaaccccuaccucacauuauaugcaaaaaguugacucagaaugaauccuagaucuaaaugcaagagcuaaaauuauacaacuaguugaaaaauaauagaaguaaauuuuuaugaccucagauuaggcaacgguuucuuauacaugagacuaaaagcacaagugacaaaagaaaaaaguuagaguagauucuucaucaaaauuaaaucuaaguuuguagguagagcaccaaaggagaaacaggcaauaugauaaggcaaagacuuuugaccauuuacagagaaaagcuaaaaugucagguugauucuaaguuagaagagaagcaaauucacauuuucuagagaagaacuacaguguccauagguaacugagaaugaggggaagcaaauagugaaaaaaauauaaaaagauaaaccauuggaauaugagucuugaaggaauaaaaauaugguaacaaaaguuuuaacauagaugaaaaugaaagcugauguuuaucaaauuauuuugaaaucacauuccuacucauucauuugcaaaaaaaaaaaaaaaaaaaaaaaaaaaaaaaaaaaaaaagauuuguucaaaucccuccaagcagcuccuguguccuggccacuaugggggauguaaacacugguuuucaugcuuagugucucuuucuugccugcaccuggucaguguaucauuucuggaggaagaaaaacugacugggugacuauaucauucuaaccaaugaucucauucaaacaauuuuuuuuucaucaaauaguaccuuuucaauauuuuuuaauuuuuaaaaaaguuuuuagacaagagcaguagugagaagaggggaaagcguagaacaaggaguuugaucuguaacugacugugaacaaucaacugagauaacucacuaccuuuggaucaguucuuuucaacauuuuugaggcaauuuuuuugcauucuaggaacugcaacauuuuuucagagaacuuuacaaacucucaaaacuuuuuuuugugaaaaugacugauuuauguuuuuuuuaaaccuaauaacuuguuaacauugaauguuuuaaauuuauuugacauaacucuuugauuuguuuuuuuaaaagucgggggcaguuagagcccuaagcccaaucucugagauuccacagaucuggcugcacaccucuauggugcuauuucuguucguuucuuuuacuuucaggaucacccacaagguuugugccacucuucauaccugugaggcacuucacccuuuagcaccuuugauucaauccaucauuggccucauuagauuucugcuuaaaaaaacuuuuucuccaccucuuucauuauuuucuguuugcaugccccucucauccucacuaucucuuuaucuugcaguauuuuucuucaaagaacuuacauuuacugacauuucuuugcacauugauuugccuacuguccaacucuaucaccagacugaaagcugcauguggguaggaauuuugcuuuauucaccacauuccugcacuuagaacgcagacccuucuaucuucuauuguacaggagagcuuuuuuuuuuuuaauuuuuuaacaaauagcccggugugauggcucacuccuguaaucccagcacuuugggaggcugaggcaggcagaucacuugaggucaggagaucgagacuagccgggccaacauagugaaaccccaucucuacaaaauacaaaaauuagccaggcauggugacacucgccuguagucccagcuacuggggaggcugaggcaggagaaucacuucaacccgggaggcagaaauugcagugagccaagaacgugccacugcacugcagccugggugacagagugagacucugucucaaaaaaacaacaaacaaacaaacaaacaaauggaguggauuuggguaaucauucuaaaccaaacuguuuuuggaauuuuggcaugucagaaagcagaugaauuacagcucacauguacgacugcacccaacuucaguccugagucucuuggcuaagcuguagcucuaccaucacauggaugaugagcaaacaucaagaacacagacgccauggccacgguguggcuggacugcuuggauucugccacuuacuaacuguauaacccagcaaguuaauugaaccucacugugccuugguuuugucaccuguaaaauuaacaauaguaucuaccucauaggauuaaaugagaucauauuugcaaaguacugcuuaggauaguggcuggcacagaguaaaugcuauauguuuuugauaaauaaaacaauuaauaaauggaaaucuaggaauguggacaaaauuuaaaaguuggaaaagcaaacuuuggggcagcuuggggaauucugucacaacuuauuuuucugaucacaagugcaaugagaauaaauuucuucccacccuacccuaaacuaaugcaaucucaauugagcgguggaacaugcuucauucacuaauuagaauuuaaaaaggaagugauaaccucacggagcacagccccauugacccugagggugacuauacaggaccuucaauugcugauucucucccauccuucucugggaucuguuucucccacccuccccauucugagguagcuggaagagaguaggcuuugugcccuuuggcgaguacagggagaaaauaguagguucagccucuccaacugcccagggagaaagcaauaccuuucaagguccccaggcuaaauuuuggagggaugcuuuugugugucacugucaggcucacaccgacauaaacccuugagaaaugccugguuggugacguccuagagguaacaccaagcaagccccagauuuucucuucuucgucagcaauucccagaugaggugcucuuguguuuacccucucugauugucuggauucccugauaguacccucuauacaaggaacuagaauguuucuuacuggauuccucuguugguggugauagaguuuacuuuggguaucuagucggucugguugccccugguaucucugguugguacaacagaauccugacugagcuccuuagugccuucuugaauacuguauaauuaacuaggccuccaauugugccccgccuugccccagcccauagauggacaaucccuccugccaugucuuaaagagaaauuaccauaauaaaugacucuccagacagcacauuucccagcaagagggggcauguaaaccaagucuauuaguauuggcagcaaaauccaauguguuauuguuaccaguaugaacacucuggguauccuggccuccuauauagauauuugaaacaaaacagacaaacaaugugaaggaaggaggaaaaacagccacacaaaugaguuacagugaguuuaaugaaaacuaauuccauugcuggguccaugugauauaaccagccacuugugcucuguucuagugguuuauaauguuaccucacccucuccaagaaauugguuucccguaaaucucuguggccauucauuccugucuacacauuauguuccuaaaauagacaccagcuaaaaaucucuuccaggagcuuugugaaggaaggccuaaauugcaaaacuccuccuagaagagagaugugauuuuguaauugcuucauugcaauuacaaaagcaacaaucauaaaagagaguuuuaaaagaguuuuucaccacagucauucuccugaaaugcacagcugagggaaagaagaaugucagaugccccgcgaacgugcagaagcucccaguugcaucacccuggcgugccagguauugcagcaaauaggaaagguaagcuacccacuucucugggcaggagaaacuaaagcaggaaucaccaaccucagcauggaauuuuccuauuucugucuggcaacauccucuugggaugauuuaaagugcuuuuuggagaaauauguucuguuacuauacuagcgcaucagaaauaccacgugaaccuguaaauccauagaagaagaagacacauuuuauaggugugauagcaacagcaauuggcaauuugcaaguuugcuacugcacucagaaauauuuagucacaugcacauauugacaguaauauacccugccuugacuuaauuguugcauuggacaggugaaaagcacauacccaccacuccagaccgauuuguuaacaaucaccagugaguaaucaaagagaacaaaaagaaaugagaaguaaaugcagcaagugggucgggucuuuaaacacauaccucaaacagguaggagucaggaaauccaugauagcaaagacauuuggacaagccucaccuccacucagaaauaauucuuaugcuguucugaaaagcaagacgguucacacuaggaacugagcaguaucugcaguaucauugcugguugugaccucugucuaaguaaaaguaagucaauguuuccuauuuggcauuggauagaaaaggggacucuuuaccacucugcucaagcucuuuuuuaguguggcucaauaggaguuggcagagguggggggcggaaaucauugccccuuccuuguucaaggcaugaggcauuucuucucaaaagcccagccucagccucaggaagcugaauaccccugcaaugcuaggcuccagcagcagccccgcugccuucuuucuuccuguggaguuaaaacugagaucuaauuuuugcuccguccuuaagaacaauaugaccucuauucccagccagcuaguccacuuccaaagcaccagugaaggagggggcuucaacaggaucaaaagggaccuugaauaggaugaaggcaagcaaaggcaagaacuggccagaugccaagcuauuucaggccaaagaaucccaucuucuaucaaaaugcugaacugcaaaacaaaccugauuucaguucauggaagguugagagaggaggggggaggggaggggaggagaagaggaggagagggaggagggggacaguuggucugaauacacauacaaaaauggacuuccugcucugcccaaacugaauuuccauggacucuuuuuccaaaggaauaacuggaaugaauaaacuuaaaaucaagaugaaacaauuagauggcuuaccugauuaaaaggaaaauuauccaucugcagugaggaacagcaucacccaaagacgagaugauaacaaugugccuucaguugcaauuguucagauuccuucuugcaaaaggugucaaaguauuuacaagggcugcagucucacuggggcagaacacacagacacacaaacacacacaaacgcacacauacacacaugcaccagagaccucugcaguauccucucggcuucauccucgccucacucuaugguaccuaauacaaaucagcaaauagcuuguuucaaaaaaaaaaaaaaaaagucaagacagcaccuuacauuacaucgccaucuaguggcuaaauauuaaacacuuucucacaauccagauuuaugauuucuuccucaaccucuuuucucucagccuuuuuuccuuucuucucuguaaucucccaguauugcuucuccuugcuucucuuucauucccuauugcuauauaauaucaugaaccuaaugacucaaagaggaaaagguuugaaaguaaauauagcuauuuucaaguaguacuugaaaaacuuuagcauuauuuuaguuugaaacuguuacuuuauuccuaauaugaaucauuguuaucuauaaaaaugauauaucuuauaaauaaaacugucuuuuuauuccaccaggaaacaaucagguggcccuuuauuacagaucuauggcuucacauuuuucuguuuuaauauuguguuuuaggauuagguuucauauuauagugaacagcucagagucacaaaaugugaguuuuacuucaacacugaugaacacaugccuuuaacaaagccacugaagucuucuauggacauuuacauucuuacuaucuucaucuguaauuacagauuaaacaagacuuucaacccacucucaauuucuaugguuuuacuauauuuuacuccaauguuuucccaucuuguggacacagccuaaagcuuaauuauaauaacacauuuuaauaagcaaauauauauagaaagagaguccaauugccuauuacccaaagauagaauuauaaaaaccaugaauaucaguuuuuucuaagacaauaaaaauccaugccaaacuaauuauaacucuuggaacugagaguagagcuuuuuauguuauauauuguauucuaaaauggaaucagccuuaaacauucagucauacauaaaaucacgauuauguguagauuagucauuggaaguaaauauuucauccucauuauuuuucuuuugccaucuaacacacuuauuacaaucauugcauguguuuuaucauuuaucaauauaaccuucaauauuuaauccuucucuuccuuauuacaggauggugagauaaauacuauuaauguuauuauauuauaauuauuccuauuuauacuugagaacacugaagcuuucugagccuuacugagguuuauucaagaccacauagcuugcaaagcaauaaaacuaaggcuguuggucccaagagcccaaagaauaauccacuguucuuugcaacauaccuaaaaguucaccauuuuuuccuguucuagaaucacagaaaaguaauuuugauuucuauguuuacaaaacauuuacuagcccuuaauuauggaccaauggguccaucuuguggauccaucuuuuuaucuauaaaagaaagaaauuaaguaagauaauuuccuguuccagcucaaaaacucuauccagugcuuucccaaaagccaguuggaguagcaugaacacauucauuugaaguuacucaaugucugggaaaugauguugcccaguaucugguagagucagggcaaaguugaaagaagaugaggagacaggugaucaacaacugguaaacgauugccaagauguuagagaugaaaagagagugggaacugcaugaacuaacaggcaauuuuuuuagaauaauacauuccauaugaauaguacuuagagauuagauauguaaaaacacaaaauaagaacauaccuggccacauguuuuaaugaauucuaauugcauauuauaggugccaauuuuucugagugucugcucuuaacaauucccccaauaguucuucuccccugauccuuagugguaaaccuacccucuugcuacagaggacuggagcaagagaggguaucuacgcagcugaccuggucaaagagagccacuacaugugauucuggcagcuauggagucagcuuucccucaccauggggacucaggaccagguggaccaggauacugaaauagcagccagccacacagauguggaggaagaagugacaaaagacagagacagacuguuuccaucuccagucuacucaagauccaaacacuuucuugauguugagucccaugauaaacucaaacuccauguuugcuuaagugaacuugguuucuguugaacuauggaguccuaaccacuucauuagcuucaagaaaguugccaguacugcaucuaucaaguauuauucauauucugggcaucugacacuucauuuauucacuucuucaugcaccugauauaugccaggcacuuuuccagauacuuaaguaacaucggcaaacaaaccagaucaaaacccucccuuuguggaguuuacauugacaugucagucauauggaaaggcacaacgcauucagugugcacacuaccuuucuuccgccuccaugucuuuguucacaaccuucacuucucuuggcagaccuuucauccaucuacacauagcaaauucggcggauauuuuaaaugucugggucaaauauucucucuucuccaacgucuuuucuauuuucucagcagauagaauucuuuuuucuuuuguuaauuauagaacaauuuuauguuguaucuuaugaaacauggucauuugacaaguugaaagcauugagcauaaggagauaaaugacuauucucauacagacuccuagaaaaggccaauaucccaagcauggcccaaagaguacuauuaacuaacaacucaucauucuguacacagauacuucauucgucagagcugaagcaguuuuacaguauuaguaacuuuaaaucuuccauguuucagacugagcauaaaggcaaaauaugagauuuuuauuaaauuaguguaauaugcacuuaaaaucacauauuuauuuuuuaaaguuagcagaagauauuaaaacaaaacucugugcuacccuaugucacuacuacacuuaucccauuugaccuuguucuaagaguuuuauauauguaucuuauuuggcucccagaauguaaacucccuguggaaccagcuuugcauuuuauuuauuuuuuuguagauuaauuuauugagagauaauuuugucucuuucucacuguuacguuuccaacuucaaaaaaugaaaaacuaaucuuccucugcccccguugguaaaguuagccauuccaggaaccccuuuguaaucuuguuucagaagcuggaaaaaauuagcugccuacuuccuaggugacaauacuucaaucuguaaugcaugaaccugcuaaacaggcugagggggcauggcuguggcuuuuuuaugagaguuccuaacaaggaaaagagaaugaaggcguaagaugucauuuagucuuuguaagacuccgucucuguaagacuccgucucuguccugugaaugugguuguuacuuuguuauagcucugucaguugcacugcucagugccaaaacauaaaagggaauauuauaaugggacauaaucucugucaauagauuuuggguauuaaagagagcgugaggucacucagguggaaaaagcugggccagguaauuuugucuguuaguuuuacgacauaaaggagagucucucgaugccauuagaucuugaaagaguucaaagagagaacuaucucauuaucagaaggcugaggaauuaguguaauuaguaucugaauauucuuuaauauuuucuugcauagaaaauaaagguaauugguuaucaaaaauauucuuucaaauguguaucuccuggaguuguggaguucugaaacuuuaaccagcugccuuaugaagagaauuuauuaauuaacuuuaugccugccaaggagaaggaaaccauucuuaauuuuuagccaaaaauuucccaaagugaugaccaaaucauuauguuuugaguuccagauucccuuguuuagaguuauaaaugacauuugaguuuuaaggcagaaauguuucuaaauuccccugucauuuguuugggaaucuauagucacugagcaacaugaagcugggucuccccucucuucccaccgcaggaaaggaauuggaggcuggaggcgaacuugaguaccuugaggugguaucccaaaggagaugguggugacaacagacaagucuagauguuagcaggucuucugaugaagucggggagugaucccaacacagauagcaaaugcuagaguuuggauuuaaacucagaccuuaagauuuuagaucuacaggaccacuguaucacuacaaauccugacuuugcccccuuuugauuggaauaaucagauaaagcacacuacugaugugauccuugguaaauguaauuuacuacuuaaguacuuugcuuuuguagaugucaauuuccuagugguuuuuuuuuuucuuuugguaaaugcagcauucugcaaaaaucuacuaccaauuccuugcucucacaaagcauucaccaacacugugccacuauuuuagaaauagaaaccauauccuagccgaaaaugauaaacucauauauuuccuuuugagauuaaccugcccuuuugaaagggagucagaaaugaaugugaaauuuauuugcuauuagacaaauaaaugcagaaacugcaauuaagaacucucuuuuaggacuagagccaacuaguuuuucugcaaguuuaaaguuacaauuuuuugauggcaagaauuggccaacugauuucaaaauaucuuauagguacuaaaguggacuuuugaaacucugguaaaguccauacauuccauaaauuaaaaaaauaauaaucagccauuuuuuucaaauaugauauaaaaauaucugagggcuccuccccuccccgcaacuggaauucacugaaucagagcugcuauaggcuugcauuuuuugaugcacagauaaccaguuuuuaaaucacuuguaauauaaugaacauaaauaauugaauuuuuuuuucuuacagauuugauucugaaguauuuuugaaguaucuuuagaaccaaugugcuugugggcacacauuacacuauuuaaaauuuuauuaaaaguauuuuaaaaauccuuagagagagaaugccaguuaucucucucucuuucugguaguggagaagaaaaaauaguauaggcuuuucuuaacucaccacaaugcaguaauuaaaagcaaaagagaaaggagggaaguugugggauuaugauggagauaaucagauuccccaguugcccucugccuucccugcuaucgagacaacgcacagaagccagaauuaugucugcaggugauuauuucagggaagcaguuacuccuuguuggaagauucacugcaauuuccuuucaauuacauaggcagacauugguguuggagagggaaauaacaauauuccuaaaccaaauaaguagcuuuuauaaacaagacagaauaauacaugaaccugauuucucaaagggaaauuaaguauaugaaugucaaucaucugaugagauuagcauuacaauauagguucagaaugaguauuaaaucacaaaauuacuuuuuaucacuugauguaauagcauuauuccucugauuauaucaccaacugaacagcacuucaaaaauuacuauagugcucuguauauaucuuuaauuuuaaauccuuuauuauuugggggccugguuuauuuuugaucuuuucuucuuuagcuaacguguaagaagacauuauuaauauuuagugaagaugacacuaaaugucguuuuucaaaacaacaaacucugccuuuuccuaaacaagcagggagccauuaugccuucacuguuccgcuuccuuuguuuccucuguuuucaggaccuucucuucuuugaccgcaucuuccuccacccucuaucggugcaccucuccacggucugaccccacucaauaaucucuuugaaaguaagaacuaugacuuauuuuuuuugucauuguuccccaaacauaucccaagucugugguagaauuaagguaguuucuggagagaaccugauaacaucugcugaguauugaugaauaaaaauuccguaauagacuuccaacaaaacccuggaguagaauaaaauaacuuuguaaaccucauaaaaaagaaugucaauuuacauaaaucauuaccauugcuuuaucgauaggguuuugcuaaucauugagaaauuguggagcuggaaaagucucagagauaaaccaggcaaguguucuuauuuuggauaugaggaaacugaugccaagagaggugcagugacuuguccaaggucacauagauaguuuuauaccacaaagguccauucaaguuuucccacaguuuaacucuaaaggaaauuaauauugaguaagguacaucagcacauaagaagcaaaauggaagugagugaaguauuucuagauaugccacaauugauuuucacucauguuuugacagagagauggaugugaugaaggguaugaaugcaguuacuguuuaagaaggugauggacuaaccaacauugguuuuagcaaagaauaaagaaagugacuguccuucaaucuagcuccacaugcgguucuuaaauauuaaccacaaaguacucaagcccaagggcacgagcucuggguaugcagaguguagcauugacagcuuucaggaaugcaggcccaaagacagcuccagaaaauauccaggaagcaaacuaucuugaaguucuauacuuucuuugaaaugccaagauguaaucuaaaaauauguguucuacuuuuuuagucuaauaaaccacauuuauaugaugguuaucugucauauggggagacaaaauucaacauuucacaugccugagcuuuauaccccuccuuuaaauguaucaagauuucauaaagcuuugguucuucagaaaagaucaagguacaucacaauauuuaaagcauuaucuccauaucuauugccacaggaggauaaagagaaaauaaacauaaaugcaaauaaugaaaaugccugagcaaucauaaagaaugaaguuacuguguggauucuauucuguguuuauguguucuuuccuuugcucuuaagucaguuaaacauaaugcuuggguucuuuccugauuuauuucauucagcaauccccccuaccccccgacaucccuugcaaagaugaaucaacaaaagcuauuaccaagaacaauaugauugauuacuuauuggaacucgaauaccaauuuuccacuuaaguauaucuuuauaucaaucaccucacuugccuaccuauugaagaguuucaauuagauuuuuuuaauaaagaggacuuucuuuacucuaaaggauauagcugauauuuaugaagacaacgcuuuauuuacagaauaaaacugaacuuugccauaacuuagcauaagcaaauauguaguuucuguuucccuaaagaauuccugucaacaucuuuuuccuuucauguucaaaggcagaaagucauugacuuuaccaggagcacagcaaagccaucuguaaaguauacaagugucgcuagaauuaggugcuaccauauuucuuggggaaauuaacauuuuugacacaucuguaugcaguuccaaucuucggauaucaauuuacaaacucacauaaauuacauuugguuacaucuuuucuuuuuguuucuuuccuugagaaaagcaagaauucuacucuaggccaaauaauggacagaaaucauuaggguccacuccagggacugaggcccuuuagaagagauuggcaagugacuagggaaaagguacaucgaaggucagaaaauaaugacauuuagccuaguucuccucgugauuccuuggaaauuuuggggcccaugagcucaguugcugcuucugggauugccccuauucauaucaaauagcagagaacugagaugucuuacccacaccugagaagauucggaugugagcaugggauagaggugcuaggcagcggcacuuucaugccuaagugcagucucucauaccuguucaucugcaguggcaugaaaggcaaacagauucuucugcucauuauggguuguugaaaugacagaaccacuuugucucaacauuuucuaugacacuugauacauaaggaagcucagagacuaaaguccuuguuuccauguugcacuaggucuuuuugaaagucucuuuuacauucugauugcuaucaugacaucaaagucaccuguauuccucaucuuuguggggaagagcaggcuaaauaaaguagguaaggacaccuucugagucugcaccccuuuaauugacacauaggggaugugaccccugacguuucugcuucccuuauucuuucugcaacuaagcaaacauagaauguggauuuucccaugcucuuagcaaggaugaaacucagcgaucauuugcucuacuucacaugguaguuguuucuaagauuacauaucauauauaugcauauauauauauguuauguuaugcuacacacacacaacugcuaaugaguguucucucuccccuuuucuugucccucugcucucuaggacagcaguagcuuuauauguaucucuaucugcccuaagucuccucucuugggcaucacaaacagaguuacccuuccaugaaccauuuguugcuuuaaaauuauaccucagaugcagucaugguccuagcagaaaguagaugguacauucaaaaugguuaaaauaaaaauaauuauggagaaacuauugaccaaguggguuaagaugguugaugagugcccaggaacuagcaauagagagagccaaugccauuccaggcaagagugaaaguggcaccagauuccggugagagcuagagcuuuagaagacccaacugagagguuuaacuaaagaggaaugcagcugcuuuuuuaagcuaggaagugagguguggucggggagacucuccaauuuucugcuaaugccugucuugggcugcauucaaagccaacggaugaaggaccccaaguuucucaaucccuggaaaguggacuugaaagucuuucccucuacuuguccauuauuccacuucuaaccuacauuuuaauacucccaacacucucuucccuggucugcauuccuuggaguccagugcuccugcuaguagcccuucuuccagggcuccagcauuuguugggcucugggaauguuuuuuccagguuggcaguugugaagggcuggugggaacuggggaaaauaacaaugugucucaucuuaucucuaaaaacaucucuuuuucuuuguuuaaaaagcaaaacacaugugucuaaaauauuuuacagagaugaacaaaaaucuuuaugauaaaagauucuauuuaauacccuaacccuuaauacagugccuaguauaugguaguguaugauaugguuuggcuguguccccacucaaaucucaucuugaauuguaacucccacaauucccauauguaguaggaggaaccuggugggagguaauugaaucaugguggcgagucuuuccuguguuguucucaugauagugcauaagucucaucagauaugauggcuuuaaaaaugggauuuugcugacacagcucucuuuuugccugcugccauccaugugagaugugacuugcuccucguugccuucugccaugauugugaagccuccccagccauuuggaacuguaaguucaauaaaccucuuucuuuuguaaauugucaugucucagguaugucauuaucagcagcuugaaaauggacuacucaguaaauugguacugggaguggggcacugcuaaaaagauucccaaaaauguggaagccacuuuggaacuggguaacaggcagagguuggaacaauuuggagggcucagaagaagaaaggaaaaugugggaaaguuuggaacucccuagagacuuguugaauggcuuugaccaaaaugcugauaaugauaugaacaacgaaauccaggcugaggugaucucagauggagaugaauaacuuguugggaacuggagcaaaggugacucuuguuauauuuuagcaaagagacugguggcauuuugucccugcccuagacauuuguggaacuuugaacuugggagagaugauuuaggguaugugguggaagaaauuucuaaguggcaaagcauucaaggggugacuugggugcuauuaaaggcauucaauuuuaaaagggaaacagagcauaaaaguuuggaaaauuugcagccugacaaugcaauagaaaagaaaaucccauuuucugaggagaaagucaagcuagcugcagaaauuugcauaagcaaugaggaucugaauguuaauccccaagacaaugaagaaaaugucuccagggcauucagaggccuucauagcagcuccucccaucacaagccuggaggccuaggaugaaaaugugguuucaugggccaggcccagaguucccaugcuguaugcagccuagggacuuugugcccuuugccucagccauuccagcuauggcugaaaggggccaacauagugcaugggucauagcuucagagggugcaagccucaagccuuggcagcucccacgugguguugagccggcaagugcacagaagucaaaaacugggguuugagaaccucugccuagauuucagaagauguauggaaacgccuggaugcccagcaaaaguuugcugcagggguggggcccucauggagaaccucuguuaaggcaguauggaagggaaauguggggucagagcccccacacagauucccuacuaguguaccacuugguggagcuaugagaagagggucaccauccuccagaccccagaaugguagauccacugacagcuugcacuguguuccuggaaaagccacacuuaaugccagccugugaaagcaacuaggagggagucuguacccugcaaagcaacagguguggagcuucccaagaccaugggaacccaccucuugcaucaacgugacuuggaugugagacauggaaucaaagaucauuuuggagcuuaaagauuugacugcccugcuggauuucagacuugcacagggucuguaguuccucuguuuuggccaauuucucccauuuugaauggcuguauuugcccaaugccuguacucccauuguaucuaggagguaacuaacuugcuauugauuuuauagccucauaggcagaagggacuugccuugagacuuuggauuguggacuuuucaguuaaugcugaaaugaguuaagacuuuggaggacuguugggaaggcaagauugguuuugaaaugugaggacaugagauuugggaggggccaggaguggaaugauaugguuuggcuguguccccacugaaaucucaucuugaauuguaacucccaccauucccaugugucaugggaggaacccagugggagguaauugaaucauguggguggguuuuuccugugcuguucucaugauagugaauaagucucacaagaucugauggcuuuaaaaaugggaguuugccugcaaaaacucucuuuuugccugcugccauccaugugagaugugacuugcuacuccuugccuccagcaugauugugaggccuccccagccacguggaacuaugaguucaagaaacuuguuuuucuuuuguaaauugcccaguguauuaguucauuuucaugcugcugauaaagacauaccugagacuggguaaucauggcagaagaugaaaggcacaucuuacauggcagcaggcaagagagaaugagagccaagugaaaggggaaaccccuuauaaaaccaucucgugagacuuauacaccaccacaagaacaguauggggaaaacugcucccacgauucaguuaucucucaccaggucccucccacaacacaugggaauuaugggagcuacaauucaagaugagauuugaguggggcacagccaaaucauagcagguagagacucaggaauaaacauauggauauucaagcaguacuauuuuuagauaaauucuaagaauaauuuuagaauaauaauaauuguuguuaauuuuauugaggacuuaauauauuuugggaccuucaaaccucacaacagucucauaaaauaguugcuauuaccauguuaucuucaugaauuuauaaaugaggcaacugaggcucagaguaguugagcaucuuggccaagaucacacaguaacgaggugacuaagugugauucugaaaccagcaguguaucuccaaaguaccuaaucuuaccauaaggccauacuaaaacucuccacaauaucacauuauuaaaauuaugguggaaagucucugcaauucgaguucacaggcaaacaaacagaagacaauagucuuucuuuacugcuaaggauuacaucacauuaagcucauauaaggacauaaugggggagagacauuucuacaaguagcugaccgaagauaguuuuuagguguaugaucagucuguagccuggauucuugucaaacauguuagggggcagcauguggcagggugggagggaggcaaauggagaucuuccuucuuacuugucucagauucuucaaucuuccauagcaagugaaagaauauaacuauguuuggacguacucucaccaaguuaacaaauacacuaaacacaugaguagugaggggagaagcaugccucaaucuggcaaagcuucaaucuccagaagucuaaauuuguuagaaaugaaaaagcuagcaaagcagaacugcugaucgugaacacuuaacaguaagcuuccuuugguggaagcuucauguugcaaacaucguauuuaauuagguguuuuuuucucagcucauuuucuaaaaacaagugcuuuucggcucugcuugauguuugugaagacacggaccgcgcaaaaccaggauacuuucagaauuuuaaaaccuugcuucugaaaguguggccacauacuggcagcauccccacuucuugggagcuuguugaaaauguggacucuuuggcuccacccagaccuucuaaauaagaaagugcauuuuaacaagauuuccccaggugauucugugcacauugguguuugagaagcccuggcugucacaucuggccucagcucuuaaagccuacucacuuccuucugcaccuugaacauguaaaucagccauucugcccugcucaccacuccccggguguucccauuccccuuugcagcccugcuuguacauacuauuuagauacaccaagcaaacccaaucuacucuucuaagucacauuucuaaugucaauugacuugaguggcucuugaaguaaaaauuaacuuuccaguuucucuucccucaggcccagucugcaguggcaaucgcuguuaauuuuuuuuuuuuuaucuucuuuagaauucuuguguauauccaagcaucugaaauauacguguuuuauauuuuucuuuuuuuuauaaauaacauuguaccagacaccaggcaugguguuucacacuuguaaucccaacaauuugggaggcugaggugggaggauugcuuggggccaggaguucaagaccagccugggcaacauacugagaacccaucuccacaaauauuuuuuuaaaaagaaagaaaaacaucacacaauauauauggcuguaaaccuaguuuaaguuacauaauuuaucucuaauuaguucacuuauuauugcuuaaaauauuuuguucuguauauagauggauauaccaaaguuuauuuaaucaguucucagaugauaaacacuuauguuauuuucuuucuuucuuccuuuucuuuuuuuuuuuucuauuucaaacaaugcggauguauacauuucuuuacaauugcauuucccacuugugcaaauuuuccuuuaagaucuagucucaggaaauggaucugucagguggaaggguaugugccuuuuaacccaguagguaucaauagauuucccuccaaagguguggcaccauuuuauauuccagaacagcauaagaaacuguuuccaucaccagaaauuaucaaacuuuuuucuuuguugacugggaaguagaaucuagacugucuuaaacuuaucuaggaauuucucugaggcauuuaugaguagacacaaagaggguggaggagaaagaggaggugcauucuaagaagaggagauacauguaggauauauguaaaguugggucuguggaaguggcuagagucuggagagguaggcagacagccagaucagaagggccuggcacaccugcuaaagagggaaaacuggaaccgcauucccaaggaauccaugaaaauaucguguugagaagauaaaaccaaauaguuugcuuuuuauuuccacaaguuuggaggagccaucuguuucuugucagggcauugacugauaauaguugugucuuuauaauuggguuguuuucuccuaaaacucaauuuagacaaaguaagugucagugugggaggguuggcuaauuguuaggaagcaacauuugguaaaucuggaggccaaacccaaaacuuuuauauuuuuauauuccugguugugcuuacuacuauaaaguuaauuauaaugcuuuuacuagaagcuguacauuugaaaucaaaacacucuaucacugcuacuuucccuucucccagcaugagguaacaauaauauucuuuaggaaauuucauauggaagguugacaccuguuguacuuuccuuaccucucugaauaaaauaauuccaacagaacacugacaacuuuuagaaauccaauuucacuguuucacuugcugauaugguuuggccguguccccacccaaaucucaccuugaauuauaauaauccccaugugucaagggugaggccagguggagauacuugaaucacgggggcaguuucccccauacuguucuaguaagugaauaagccucaugagaucuguugguuuuauaaaugggaguucuccugcacaagcucucuugccugcagccauguaaggcgugucuuuucuuuuccuuugucuucugccaugauuaugaggccuucccagucauguggaacugugaguccauuaaaccucuuuccuuuauaaauuacccaaucuuggguaugucuuuauuaccagcacaaaaacggacuaauacacucguugaauauaaaacagaaaaaggaaugccacuuuaucagagagcuauaauuucauuugaaacaaaacaagaaagauuuauuuuuucagaacucagcauuuuuuuuuuuuuuuuugagauggaguuucgcucugucgcccaggcuggagugcgguggcaggaucucggcucacugcaagcuccgccucccggguucaagccauucuccugccucagccucccgaguagcugggacuacaggcgccugccaccacgcccggcuaauuuuuuguauuuuuaauagagacgggguuucacuguguuagccaggauggucucgaucuccugaccucaugaucugcccaccucagccucccaaagugcugggauuacaggcaugagccacugcgccuggccagaacucagcauuuuuaucaaacaaauuccagauccuaagacaugugugacuaaggauguauuuugggguaaaugaggaaaacaaaaauguugagaccuuuacuuaucuucaauaaucaaugcaucuccaaaauggcgcuauuaaaucuaaucaucuuggauuugguugauauuuggauggucauauugccgagcuaaacuccuuuaccuagaauauuauaauuagaaaaaagucugaggaaucaucuaauucaggcucucaguugacaaagaauuuaccuuacuuugguaaaaauuuguuuggcuuuauguggagguuucucaaaaaacuuugaauaauuauuuucugaaauaauauucuaaauuggaaauuggaauaaaagaucauucacguucaucuugaguauucacuuuaagacuaaagagggaagugacuuugugauccagguuugugacauuguauuuuaaaggaggaauuuauauuugaucuugggaacaauuuuucacauucaaagucugagaacaucuccguaucaaacccaaagagauuuucucaagugaaauaaagugaaacaaagaaaguagcauuagcaguuccgaguugcagacaguucuuuuuaaaauuuguuuuuugguucuuccaggccucauuugcaaguugcuacuuaauuaacuagggugguuaauguuagguaaaguccaaaauguaaaggaacuacauagcaauaacaauauuucaguauuucuucaauaaaaguuacugacacucucuauaugucaagcacuggagggugccagugaaaagagauggucuguugcuauguucugcauuuucguuggugaaaacagagaaguuggcugggucaucagugugguaccucugguaaagcucaaguauagggaaauuuaauucaaucucauguuugaauuauucccucuuaaggggguaauaauccuauucccauggaguuuuuugagggcacuaagugauagaacacaugugacuaugacuaguauaauaaaugauguauuaaaaucauucuauaauacauauaccggaaaauuaauuaagcauaugauacgaauaaauguaugauaagucagguaaaaugcauuaauccuaggaauaaaacaaagcacugguaaucucucugaaggucuuagagcaggaagacucuugagacaggucuuuauaaaaaaucacuuagaaauuauacuuaccaauguguucaaacuacaugaacuauugaguuuugcuuuguaggauaguggaacgagaagugaauuuggcauuuggagaccuugagccuuuauuuucucacugcaaaaugacagagauaauggggccuaucuuuuagaguugcuaugggucucagaaaggaucaugguuuuuuuuuuuuuuuugagacagagucucacucugucgcccaggcuagagugcaguggcgugaucucggcucgcugcaaccuccgccucccggguucaagcgauucuccugccucugccuucugaguagcgcaccaccaugccuagcuaauuuuuguauuuuuuaguagagaugggguuucaccauguuggucaggcuggucucaaacuccugaccucaugaucugccagccuuggucucccaaaguguugggauuacaggcgugagccacugcaccuggccuaaguaauuuuuuuuuuuuuuuuuuuuuuuuuuuuuuugugggggacagagucucgcucugucguccaggcuggagugcaguggugcgaucucaggauuucacuguguuagccaccuggucucgaucuccugaccucgugaucugcccgcuucggccuccccaagugcugggauuacaggcaugagccaccacucccggcagggaucauguuuuuaaaauuacuugaaaauacauauauagucauucaaguaugagguauuauuauuuuaacagaaauauagcuaccuauaucuuauauuagguuccuuaauccacauauaucucagaauagcaccuaauuugaauuguagaauaguauauugaaaagaaucuuuaacuguuggagaaaaauuuguguguguguguguguguaggcgcacaugcaugugugugaggcuugucuacuucuaucgcacauaucaggucgagaaaaugucuguacuaaauugccaagugguuuagguaaaaauucaugggaagguauaauuuaaaauucugagacucuagcuuguaacauuuguaauuuuaaggcuaaagacaugaaaaugaacuuaaauucaauauuccuuccaacagccuaugauuuuauaacuuuaugauuauaccauaugaccccaacugccuucuauguauggugaaugguucuaaauugaaggcccuuuaucuucuaaacucuuugaugaguuugggcaucuacgucuggauauaagagcuguggagagauggacuacuuuccauacuaagaagagaaaaauuuggaguguucagaucucucagggaggggaugaggagcagagaugggauggggaagggagaaaaugcggguagaagcccacaucuuuaauaaaauuuauuaaauugaaaaggugauugguguagguaagucucuguuaaaaacuagggacagacagacacugggucacuugacagagugguuagguguaguauacaugaaaccacgaugccaggacacagaggaugauguaagacuaagucccugauaaguugcagaagguuuuggacuuccacugacugugguauugguagauaccugagcaagauaucugccaacagauaucuaccaauagaucgucaccuagaucuucaagggugcaaacaggucccaccuuauaccugaguuauacaaguaaaacaugucuucauuuauuuauaaguuuuaaccuaccuacuuccaaaaggauaaaugauauauuuguuguauuauuuauuaugauggaacuuuucauagcggagcuaaucuaggucagugguucucaaaugaggaggaggucaguuuugccuuugguagacagguaucaaugucuggaaauaucuuuggucaucacaacugaggguuucuauggacacuuuguggguagaggcaaggacccugcucaaaauuccacaaugucugggacagaccccacagcgaagaauaucugacccaaaugucaauaguacugaguugagaaacccugauguaagccaaccucucaucuuaauaaaugagaagcugaacaucaaagagggucagugauaugugccaaaucacacagugaacaaacagauaaguccucuaguauuuuucccauuacaguauuuaacuucuaagagcuaaaguucuaaaauggaacuguuggaaaauagaccuucuuauggacauauuuagacuuaagguauacucaauaauugcauaaaucuuuaaaacauaguacugcuuacaguaggauaucuaggcaaagaugaacauagaaaauuuaaugacaauauguauuuaacuauauacaguaaaaaccauuuuuauaauauuuaaccaaauuacuucccagcacagugguucucagacuucagcaugccucacagucaccuggaggaaaggcuuacacaaacacagauugccaggacccaucccuagagcuucugacucaguaagucugucaugaggcccgaaaacaugcauuccuagcaaguucccagguaguacugauguugcugguuaggagaccccacuuugaaaaccacuguccuagaauuuaguagguacuuaguaaauuuuggcuuaauauuguaaauauucaaacaauauaaucucaccaaaaaauguaaucucacuuuaacauagauuaguuaauaauguuaauucccauuuagaggaauacaaagauauauaugguagaaucaaaacuaauuuaaaccucauuuaauucaaauuccccauuuuaaaaugaaaaaauuaauauauuuuaagcuuauuacaacaaagaagaaucccuuuuagcaauagccaaaagaaacaauauuaaaugcaaaucaauuauagacaauuugaacacugacauuguuaucugaaagauauauaaacucaaagauuauaaguacaauuaaguauguauccaucauuuuuuaacuuaugaggaauagucugaaugccaaacugaguaaaaccuggucugauggggcucuuaucucaagcuaugucuagggaaaaugccuauugacuucaguaauauaaaaucaggccccgagggaccauaauugucucuuuaaauuauuugggaaaucauguacauguuuaaucaacuaaauacagcauacaauuguaagugguauauuuucaucauaaauaaucaaugugcugcuguuaauaugguuaauagaaugaaaaguaccuucaggggaauuuauuuuacgaucacucauuuucauuccuuuaauuuaauuuuuaaaaugcaagaaauuuuagauacuuuaaaacuaccuguuuaccuagaaaguaugugcuaaguaaccugccuaaugccagucaucacugagagacaccaaaacaaaugauugauaguuaacuuuccauuuugcucuuugagaucacguagacaguuuaugcagacuuuacuuuccuaacucaugucauccuguccaagguacugaacuucacuugccaaggacacacaggaagauaaacccucucaaaugugcuacauuugucuucaacuuuuuaaauauccaucuauuuuuuagauuagaugccaucuguuguauuaucauaucugguuaaaucuuauuaaaauuccuggccaauauaucacucugcugcggcaaucuuacccugcuaccucucuaggcuuuucugcagcauucaauaaagagccugcuauuuuaacuaauugcugaggcaggacacagugugagagucuaaaacagaaucagcgcuauauuguuucuacuuuuacccauagagugaacaacuguucauaucaaaccuggaaucaucccuucaagucuccuaaacacagcacaguuugagccaaugcaguuaauccacccuccuucagugcuagugucgaauggcgcuuuugcugcaguauucaccuugaaacuaaguaggcaggauucauuauuuguugaagucaccuaacugccaguuuauucuuauacgaucacaaacaaucacaacagaagacaaauacaggcauauauauaacucacuuacaagggaagcaaauuugcagccagagacaagggcaacguaacagccaagaacugcaguaaaucucuuugagcuaauagccaccucuaauaaugcucuccuacaacaccuccaaucaaauaaauuguauucagaguuuaaauaucaaaucaacauucauuccuugaugguuacagaugauguccgauaagcaaauuugaauuuaugauuuauuuacuccuuaagugucucaaagccaggauuacuggaagacuuacuaugcuuauucaagcaugcugacagaacuguaaucucaguaauuucucccugcaccucucagcaugacugacaggcaucugccaagacuguaguacauaaacugcugaaacaugcaaaaauauuuacccccaaaagauguaguaaaagcucagcuuccuccagcuuccauaaccccugaaguguuaaucuggaggaacaguuccaugaguuuccacaggccagcagugugucuccuacacuu

SEQ ID NO: 3 - DNA, 123 bp, Homo sapiens
gtttcattggtcagtttaacagcaaatgccttgggttactcagaacttggagccatcaaatctctcaggacactaagagctctgagacctctaagagccttatctcgatttgaagggatgagg

SEQ ID NO: 4 - DNA, 6965 bp, Homo sapiens
gtaagaaaaatgaaagaacctgaagtattgtatatagccaaaattaaactaaattaaatttagaaaaaggaaaatctatgcatgcaaaaggaatggcaaattcttgcaaaattgctactttattgttttatctgttgcatatttacttctaggtgatatgcaagagaaataggcctctcttgaaatgatataatatcatttatctgctgtgcttatttaaatgactttatttcctaatccatcttgggagtttccttacaaatctatatacaaaaaaaagctgatgcattattaaagtactatgtgtaatgatataatggtaatctaaagtaaattctatatcaggtacttattctttgtgatgatatactgtacttaacgagttttcctgaaaataatgtgaatcacacatgtgcctaagtatgagtgttaagaaaaaaatgaaaggagttgttaaaacttttgtctgtataatgccaaagtttgcattatttgaatatattcaagattagatggttagatattaagtgttgactgaatttataaaactagtaatactaacttaaagattacatacaaatccacatcatttttataacaataaagtaaaacacttataatgaacagaaaatataattttgactcattactataggtaatttatacattaaccttaacttgcatcttattggtcagagtcacacaaaatgttattttatccttttcaaagatgcaataatcattttccatcatgcataacagattagaaattttgccattattgacttattttccatgcctttttttacggcatgaagcattagtttatagatatataatataaaaaattagttctgcttttttttaaaaaaaaatattatcaaaacaaaacactgaattgtgtgattccaatagaaaaacactgctctttcacctcctaaggtgtagttacttttatggaaactaagctgtattgtagacttccatttgcactttgtagattgtttatagccttatgttctcttctcaagtcttattataaatgtcactttgtaagaacgtaggacttgtcttcgatttccctaacatatatgaaaactttgtcctcattatcgacaactcagaacaatataatacaagtagtcctcttttatttctcacagagagcctcaaattttcaccaaaatgttaacagaaattatctctggggtgtataagaattaagtctgttttccaattaaatgtcactttgttttgtttcagactggcagtttcagttctggagaaaaaaaatgtcatttgtgtacattctacttgaaaacatgttgcctgaatcaaaataatatattttatatggcttgtgaaatctgaacaatgctaaacatttgaaaatattataaaccttttacatttgaccatttgaaagtttattaaattcattggtcaagtgctcagatatttccatacattacacttcatttctataaaaaagctgatcttatcggtatacttttaattttctcagaaataaccatatctataattattaatcaataatgccttttatattaaaagaggttagtttttgaaacttggagttttagacataaaatccttataaatgctgatagtgatataactaatagtttaaatggtcagatttatgaatatggctctattcctcataatgacaacatacacacagcactaaaatgactaatctcttcaatacgtgtttggcattgtagagtcaaaataacgttataattgattctattttttatacttctagtgtttggatattttattttgtaaaaatataatcatgaatgatggtgaggttggatataagaatgatgattatgattgggaagtgagatttgaacatgctcagaaactctcatttaattctttgccctagcagcataaaatcacaatagctgcgtcaaagcgtaactcaggcactcattttatttttgttgttctgttattttttcaaagcatgtgcttttatgcaacattactgaataaagcatgttgtacagtgcttgataagaagttagaaagtaacaaataaattatcatcacgttgcactttgtgttttgcatgttttatgcacatttctggctgacagcttttaaacatttattgtatttcaaatttccagtccaaatttttcaacttgtaaaattaaactgagtgaattgatgtcgtgaatatctagggtaaaataaaatttgtgtttaaatttgtatttttaatttcctaacctaggaaatcttaaataccttctttttcaaaagaactcaagtcttaatggatagggaaacagacggagagcatcatgaacaaaaagtaacaccaaatgttctgtcatatcagatttctaactaataacaaactatatatttctattttgtataggataatcttgctccaacttggatggggtggagcgctggttcctcccctgagccctttattatgggtactgtattaccccttttgctacctttaatccttgcactgtgacttatgtgtagtggggtgagggagggattgggaagggtactattattgcaccacagtagggaaaatacattatttacatcctaatcccctcttttcaattgtcttaaatttcatttgaaaaaaaaaaaaacctttatgaatttaccctctgtggattttaaccccaatggttgatatctttattaagtttcattgaatatgatttagttatgtgtatatggagttatccatctttggggagattactggattggtgagggcgggggaccctggtgtagaatgattatgtgaaaaaacaatttaacttgttaagctcatgatactgtttgaggcatacagcccctgctgtttagtacattggtctgggtcctgaaaattaccagttagataccatcagttgattattgatatgtatgagcagatactagggtgcaatatttcaggtttcataagactggtattgattgtgaccactctcattttttattgtgtaagttcatatggggttattttcaaaatgttaacaaggcaaaaatatattaagaaatagttgaataagcacatgtgaattgtgttgtaaacaaaaagttagaataaaaaaatccacttatttgaattatgcagaatagaatacatacctagaaataaaacaaaaacgtcttatcatgagtattaagataaaatttaaggcataaactcacttcttagaataagtaactcccaactaactttctaggattttaaaacataacacagtgaaaacatacataaacataactctacattttatttattcttaaagtttaagtgtattatacaagaagaagagtttatattcgagagacagaaaaagtcagaatttttgtttggatcaccaatatatcatagcttacaaaaaaactgtcttaattaaaacccacaacataatttttttagatttttaagaaagattctattattcttctttatacttaaaaatggatgattcctactttgcccacttttatttttattcacatagattttctttatttctattagagaagcactagaattcatgaatagtgttgatttgaagttcaaagtaattaattcagataaaaagacatttctgcatgtatgaaaatttctaatgtgaatttgcatatttaattatcaatccttcatttagtgtagacttatttttaaaaatgcaggtaatgaaccagaaatagaattggttgtgctagagtagagaaactttatttgatgattgttttgaaaaaaaagcttctgagaagaaacaacctctagtacagtattaattcattaagatagctcctttctcagacatttcctttcatgtagcctgaaagttcaatttgaaatttgttctttccaatttattcagactaattctgcctactttcttccccccataagaaccaattactgcagctttattgagactgaaaaaagttaatacacctccttctttgctgaaccaaggaatggcttggaactcttgggaaaagacaatcttttctatgatctttcattgtctaatttaatacatcataaatatgactatagctttgtataataaactccccaatactgtgccagatgttttctaagataaagttattttatgttcacaaaaaaaataaaacttttctctgggccaaatgtatgccaactttgcaaatcatatcctgaagtgcactgctgcagagtacatgcttgcgtcataaattccatagagttcgctttaactctaaatcaatccccagtttcaaagtaaacctctcaaacatattacctaagcacaaacttctccctgtgctcagttccttaattattctcatcccatattcagaaataacatttaaaaattatgctttgatcaataaatactaatctaaactttgcttcattaacccattcatttttgtcaaccattattttattcctatattcaaagctctctggtatgttcttatattcaagacactcaaggccctggaagattcacgaacatatgtttgcatcttaaatttttagaaaatcttacaatctgtcaggattacactgaactctagtacagagtaatatgggtaccagataagtgggagcaactcttccacgtagactggaaacagcactaaatgctatttataggctactttctgaacttaacttgttttaacctcatttttctcatatgccaaatgagaacgcaatactgaattatctgtacagttctgttcagtactagaattctgattcttgaattcaaaggggaaaacattcctctttattttggaggctaaactgggggacaaagttaggctccatgaaagaagtgctatttgaactaaagcctttaagaggggagagtatttcagaagaggagctattagacaaggaatttcaatgtaaatggcatctcaatcacctggcaattatattagcacacggttattatattaattgaagtggcatgaagtatagatgaccagggaagttaaaactggaaatatagattgtggagtgatgtgaataccaaggtaagaaaaatatttgttagttaccagagagccaataaataactttcaagtgggacttggggaagattaattcatcttacatagattaaatgaaggagaaggttaggagacagatgacagtgcaagtatgaaataacagagggcagttctaggtggtgactgtgagaatggaaaagaggtggcaaagctgagaaacgtttcaaagaaaaaatgtgagacaggtaatgtgaaaagaaaatcgagaaataggtatagataatcagtgttctgctcatactctaaattgggtgttgaaggcaaaatacgtattttaattagtactctgtgtatacacactagaaacagcattgtaatctggatagtggacaaaatattcagaaaagaagggaaatagtaacttgatttcaatttccaaatctctaatctgaaagaaatctaattctattcatccatttaaaataaattatataacgagaatttatgaagtccattgtattaatgcagacagtcagatgagataaggcaaagtgtcacgtgtcagcttggtagttgcatcggccacatcatttggttctgcctggataactcaaccaaattaatttttcatactcatcccctccacctttgtcattactggtattcttattttctttggcccacttatcacactgttttatgttccccagaaggcctagagttctttacaggctttaaacagggatcagaagtataagaaattggctcatgtatttttttttcagacaggcagttaaaaaaaattgttctaaaaatacactggcatcaaatggcaaatagaagatgttttgacgactacttccattggatcagactgacaagaataatacaagcacataggtggaattaaacttagctattaatgtccaagtttgaggcagctgccccttataagcattttagggtctgtttttagcttccctcttagccactcctgtgcagctccagtgggaggtatggaggaaaaagcaaggaagccatccctatgttgtttccaaacatgaacactcaagatttttaactagtggtccagaagtaaagagggggaaaacatccttctatagaaaaaaaaaaaagtagataataattgaacacagaacttcatgtgatcacatcagatttgagaactatgtatggcatccctctttttcttattttcctaagaaatgatttctattatgtttcatttgaaataagttttttgaattaaactcagtaaatgaaacaactgacatgactggagcttgaaataaacgatgtgatgatctaatgaaatacataatgcaaattgtcttgcttcttatgcaaaaattattagtcatagcaatgcatgaataattaaagacaattatattaggtatttaataatattttttatatttatcatctgaatttttaagttattttaaaaatatattggtcaaatcaactcaggtccaaatgttttagttttgttctttaatatattgcctttttaaaatgagttaaacttctgtataggctttttaacttttctttattctgataacacaattctgacttcatctggcagcaagttcctctgattttccttttcctttaaccttttaatgcttctccctcccttttttttaaaaacatttttgtttcatttcttggttatattgcctatagttgttttcctaagtgtattgcttaagaaaaaaaaatgaattttaagatttttttgaaccttgcttttacatatcctagaataaatagcattgatagaaaaaaagaatggaaagaccagagattactaggggaattttttttctttattaacagataagaattctgacttttctttttttccatttgtgtattag

SEQ ID NO: 5 - DNA, 282 bp, Homo sapiens
gtggttgtgaatgcccttttaggagcaattccatccatcatgaatgtgcttctggtttgtcttatattctggctaattttcagcatcatgggcgtaaatttgtttgctggcaaattctaccactgtattaacaccacaactggtgacaggtttgacatcgaagacgtgaataatcatactgattgcctaaaactaatagaaagaaatgagactgctcgatggaaaaatgtgaaagtaaactttgataatgtaggatttgggtatctctctttgcttcaagtt

SEQ ID NO: 6 - DNA, 64 bp, Homo sapiens
gataatcttgctccaacttggatggggtggagcgctggttcctcccctgagccctttattatgg

SEQ ID NO: 7 - RNA, 123 nt, Homo sapiens
guuucauuggucaguuuaacagcaaaugccuuggguuacucagaacuuggagccaucaaaucucucaggacacuaagagcucugagaccucuaagagccuuaucucgauuugaagggaugagg

SEQ ID NO: 8 - RNA, 6965 nt, Homo sapiens
guaagaaaaaugaaagaaccugaaguauuguauauagccaaaauuaaacuaaauuaaauuuagaaaaaggaaaaucuaugcaugcaaaaggaauggcaaauucuugcaaaauugcuacuuuauuguuuuaucuguugcauauuuacuucuaggugauaugcaagagaaauaggccucucuugaaaugauauaauaucauuuaucugcugugcuuauuuaaaugacuuuauuuccuaauccaucuugggaguuuccuuacaaaucuauauacaaaaaaaagcugaugcauuauuaaaguacuauguguaaugauauaaugguaaucuaaaguaaauucuauaucagguacuuauucuuugugaugauauacuguacuuaacgaguuuuccugaaaauaaugugaaucacacaugugccuaaguaugaguguuaagaaaaaaaugaaaggaguuguuaaaacuuuugucuguauaaugccaaaguuugcauuauuugaauauauucaagauuagaugguuagauauuaaguguugacugaauuuauaaaacuaguaauacuaacuuaaagauuacauacaaauccacaucauuuuuauaacaauaaaguaaaacacuuauaaugaacagaaaauauaauuuugacucauuacuauagguaauuuauacauuaaccuuaacuugcaucuuauuggucagagucacacaaaauguuauuuuauccuuuucaaagaugcaauaaucauuuuccaucaugcauaacagauuagaaauuuugccauuauugacuuauuuuccaugccuuuuuuuacggcaugaagcauuaguuuauagauauauaauauaaaaaauuaguucugcuuuuuuuuaaaaaaaaauauuaucaaaacaaaacacugaauugugugauuccaauagaaaaacacugcucuuucaccuccuaagguguaguuacuuuuauggaaacuaagcuguauuguagacuuccauuugcacuuuguagauuguuuauagccuuauguucucuucucaagucuuauuauaaaugucacuuuguaagaacguaggacuugucuucgauuucccuaacauauaugaaaacuuuguccucauuaucgacaacucagaacaauauaauacaaguaguccucuuuuauuucucacagagagccucaaauuuucaccaaaauguuaacagaaauuaucucugggguguauaagaauuaagucuguuuuccaauuaaaugucacuuuguuuuguuucagacuggcaguuucaguucuggagaaaaaaaaugucauuuguguacauucuacuugaaaacauguugccugaaucaaaauaauauauuuuauauggcuugugaaaucugaacaaugcuaaacauuugaaaauauuauaaaccuuuuacauuugaccauuugaaaguuuauuaaauucauuggucaagugcucagauauuuccauacauuacacuucauuucuauaaaaaagcugaucuuaucgguauacuuuuaauuuucucagaaauaaccauaucuauaauuauuaaucaauaaugccuuuuauauuaaaagagguuaguuuuugaaacuuggaguuuuagacauaaaauccuuauaaaugcugauagugauauaacuaauaguuuaaauggucagauuuaugaauauggcucuauuccucauaaugacaacauacacacagcacuaaaaugacuaaucucuucaauacguguuuggcauuguagagucaaaauaacguuauaauugauucuauuuuuuauacuucuaguguuuggauauuuuauuuuguaaaaauauaaucaugaaugauggugagguuggauauaagaaugaugauuaugauugggaagugagauuugaacaugcucagaaacucucauuuaauucuuugcccuagcagcauaaaaucacaauagcugcgucaaagcguaacucaggcacucauuuuauuuuuguuguucuguuauuuuuucaaagcaugugcuuuuaugcaacauuacugaauaaagcauguuguacagugcuugauaagaaguuagaaaguaacaaauaaauuaucaucacguugcacuuuguguuuugcauguuuuaugcacauuucuggcugacagcuuuuaaacauuuauuguauuucaaauuuccaguccaaauuuuucaacuuguaaaauuaaacugagugaauugaugucgugaauaucuaggguaaaauaaaauuuguguuuaaauuuguauuuuuaauuuccuaaccuaggaaaucuuaaauaccuucuuuuucaaaagaacucaagucuuaauggauagggaaacagacggagagcaucaugaacaaaaaguaacaccaaauguucugucauaucagauuucuaacuaauaacaaacuauauauuucuauuuuguauaggauaaucuugcuccaacuuggaugggguggagcgcugguuccuccccugagcccuuuauuauggguacuguauuaccccuuuugcuaccuuuaauccuugcacugugacuuauguguaguggggugagggagggauugggaaggguacuauuauugcaccacaguagggaaaauacauuauuuacauccuaauccccucuuuucaauugucuuaaauuucauuugaaaaaaaaaaaaaccuuuaugaauuuacccucuguggauuuuaaccccaaugguugauaucuuuauuaaguuucauugaauaugauuuaguuauguguauauggaguuauccaucuuuggggagauuacuggauuggugagggcgggggacccugguguagaaugauuaugugaaaaaacaauuuaacuuguuaagcucaugauacuguuugaggcauacagccccugcuguuuaguacauuggucuggguccugaaaauuaccaguuagauaccaucaguugauuauugauauguaugagcagauacuagggugcaauauuucagguuucauaagacugguauugauugugaccacucucauuuuuuauuguguaaguucauaugggguuauuuucaaaauguuaacaaggcaaaaauauauuaagaaauaguugaauaagcacaugugaauuguguuguaaacaaaaaguuagaauaaaaaaauccacuuauuugaauuaugcagaauagaauacauaccuagaaauaaaacaaaaacgucuuaucaugaguauuaagauaaaauuuaaggcauaaacucacuucuuagaauaaguaacucccaacuaacuuucuaggauuuuaaaacauaacacagugaaaacauacauaaacauaacucuacauuuuauuuauucuuaaaguuuaaguguauuauacaagaagaagaguuuauauucgagagacagaaaaagucagaauuuuuguuuggaucaccaauauaucauagcuuacaaaaaaacugucuuaauuaaaacccacaacauaauuuuuuuagauuuuuaagaaagauucuauuauucuucuuuauacuuaaaaauggaugauuccuacuuugcccacuuuuauuuuuauucacauagauuuucuuuauuucuauuagagaagcacuagaauucaugaauaguguugauuugaaguucaaaguaauuaauucagauaaaaagacauuucugcauguaugaaaauuucuaaugugaauuugcauauuuaauuaucaauccuucauuuaguguagacuuauuuuuaaaaaugcagguaaugaaccagaaauagaauugguugugcuagaguagagaaacuuuauuugaugauuguuuugaaaaaaaagcuucugagaagaaacaaccucuaguacaguauuaauucauuaagauagcuccuuucucagacauuuccuuucauguagccugaaaguucaauuugaaauuuguucuuuccaauuuauucagacuaauucugccuacuuucuuccccccauaagaaccaauuacugcagcuuuauugagacugaaaaaaguuaauacaccuccuucuuugcugaaccaaggaauggcuuggaacucuugggaaaagacaaucuuuucuaugaucuuucauugucuaauuuaauacaucauaaauaugacuauagcuuuguauaauaaacuccccaauacugugccagauguuuucuaagauaaaguuauuuuauguucacaaaaaaaauaaaacuuuucucugggccaaauguaugccaacuuugcaaaucauauccugaagugcacugcugcagaguacaugcuugcgucauaaauuccauagaguucgcuuuaacucuaaaucaauccccaguuucaaaguaaaccucucaaacauauuaccuaagcacaaacuucucccugugcucaguuccuuaauuauucucaucccauauucagaaauaacauuuaaaaauuaugcuuugaucaauaaauacuaaucuaaacuuugcuucauuaacccauucauuuuugucaaccauuauuuuauuccuauauucaaagcucucugguauguucuuauauucaagacacucaaggcccuggaagauucacgaacauauguuugcaucuuaaauuuuuagaaaaucuuacaaucugucaggauuacacugaacucuaguacagaguaauauggguaccagauaagugggagcaacucuuccacguagacuggaaacagcacuaaaugcuauuuauaggcuacuuucugaacuuaacuuguuuuaaccucauuuuucucauaugccaaaugagaacgcaauacugaauuaucuguacaguucuguucaguacuagaauucugauucuugaauucaaaggggaaaacauuccucuuuauuuuggaggcuaaacugggggacaaaguuaggcuccaugaaagaagugcuauuugaacuaaagccuuuaagaggggagaguauuucagaagaggagcuauuagacaaggaauuucaauguaaauggcaucucaaucaccuggcaauuauauuagcacacgguuauuauauuaauugaaguggcaugaaguauagaugaccagggaaguuaaaacuggaaauauagauuguggagugaugugaauaccaagguaagaaaaauauuuguuaguuaccagagagccaauaaauaacuuucaagugggacuuggggaagauuaauucaucuuacauagauuaaaugaaggagaagguuaggagacagaugacagugcaaguaugaaauaacagagggcaguucuagguggugacugugagaauggaaaagagguggcaaagcugagaaacguuucaaagaaaaaaugugagacagguaaugugaaaagaaaaucgagaaauagguauagauaaucaguguucugcucauacucuaaauuggguguugaaggcaaaauacguauuuuaauuaguacucuguguauacacacuagaaacagcauuguaaucuggauaguggacaaaauauucagaaaagaagggaaauaguaacuugauuucaauuuccaaaucucuaaucugaaagaaaucuaauucuauucauccauuuaaaauaaauuauauaacgagaauuuaugaaguccauuguauuaaugcagacagucagaugagauaaggcaaagugucacgugucagcuugguaguugcaucggccacaucauuugguucugccuggauaacucaaccaaauuaauuuuucauacucauccccuccaccuuugucauuacugguauucuuauuuucuuuggcccacuuaucacacuguuuuauguuccccagaaggccuagaguucuuuacaggcuuuaaacagggaucagaaguauaagaaauuggcucauguauuuuuuuuucagacaggcaguuaaaaaaaauuguucuaaaaauacacuggcaucaaauggcaaauagaagauguuuugacgacuacuuccauuggaucagacugacaagaauaauacaagcacauagguggaauuaaacuuagcuauuaauguccaaguuugaggcagcugccccuuauaagcauuuuagggucuguuuuuagcuucccucuuagccacuccugugcagcuccagugggagguauggaggaaaaagcaaggaagccaucccuauguuguuuccaaacaugaacacucaagauuuuuaacuagugguccagaaguaaagagggggaaaacauccuucuauagaaaaaaaaaaaaguagauaauaauugaacacagaacuucaugugaucacaucagauuugagaacuauguauggcaucccucuuuuucuuauuuuccuaagaaaugauuucuauuauguuucauuugaaauaaguuuuuugaauuaaacucaguaaaugaaacaacugacaugacuggagcuugaaauaaacgaugugaugaucuaaugaaauacauaaugcaaauugucuugcuucuuaugcaaaaauuauuagucauagcaaugcaugaauaauuaaagacaauuauauuagguauuuaauaauauuuuuuauauuuaucaucugaauuuuuaaguuauuuuaaaaauauauuggucaaaucaacucagguccaaauguuuuaguuuuguucuuuaauauauugccuuuuuaaaaugaguuaaacuucuguauaggcuuuuuaacuuuucuuuauucugauaacacaauucugacuucaucuggcagcaaguuccucugauuuuccuuuuccuuuaaccuuuuaaugcuucucccucccuuuuuuuuaaaaacauuuuuguuucauuucuugguuauauugccuauaguuguuuuccuaaguguauugcuuaagaaaaaaaaaugaauuuuaagauuuuuuugaaccuugcuuuuacauauccuagaauaaauagcauugauagaaaaaaagaauggaaagaccagagauuacuaggggaauuuuuuuucuuuauuaacagauaagaauucugacuuuucuuuuuuuccauuuguguauuag

SEQ ID NO: 9 - RNA, 282 nt, Homo sapiens
gugguugugaaugcccuuuuaggagcaauuccauccaucaugaaugugcuucugguuugucuuauauucuggcuaauuuucagcaucaugggcguaaauuuguuugcuggcaaauucuaccacuguauuaacaccacaacuggugacagguuugacaucgaagacgugaauaaucauacugauugccuaaaacuaauagaaagaaaugagacugcucgauggaaaaaugugaaaguaaacuuugauaauguaggauuuggguaucucucuuugcuucaaguu

SEQ ID NO: 10 - RNA, 64 nt, Homo sapiens
gauaaucuugcuccaacuuggaugggguggagcgcugguuccuccccugagcccuuuauuaugg

SEQ ID NO: 11 - DNA, 170057 bp, Mus musculus
taaaataaaaaattaattttattagatttgcacattttttaattgtgattagcatcattttgggctaatagtagcattttccaacatgcagttcatgaatacggtttgcctaaatattttttttttaagaaaaagaggtgcctacggtctgcttctgtaagaaacacaaatatcttgatgtaattgactatataagtgtaatcctctctgattttgaggaaaagaaattctgaagcccacatttatatttagaacaatctaaagaagcatgatttcaaagcaaagaaaaataaacagaaattggggaaataaagaaaaaaatgagaaaaaaaagcactctggtcatctgttagcacaaacactacaataaatataaatcaaatgttataccttttccaattgcaaatcataatttggatgtgaagttgtgagtgtattttgccccttaaaattatgaaataatccaaaattaacaattgtaataaaaaagcagagatctaccactacccagtcatagtttcatttcttagttagcaaatatcttccatgaaaaactgctgtggacagaaagtaagaaaagtgattgtgatatcaacctgaagataatttcctcttcatatgtacataatgctgaaaagtaaaagaaagtgactttgtacagtatttatatttgcttataaaactctaaacatgtttttaacaggttaagcagtagtgttgtcttttgaacacgtatgtacagtctggctatacattgaacgttatccacttaaattttaaaaacaacccaaacattgttaaagtgctgcaaactattgcttaatgacttaaagaaatgaagtctgctgaacagtttccttgacttagccactgacctatggtttctcgtgagtgagattctgagtgctgagagaaactagataccgcaacgtggtaatatcgacatgcattggcagcatccacactatctacaatggtacagagtacagtatatttccggtggacagcttgcactctacatttctcgtggtacatatttgatgcaataaatactgtgcttacgtcattatttgtttgctcaaacgtgcaccacagagtaaaatgactatttacataataaatagcatttcattaacacatacagtgtcaaccttgctgagagctgaagatggctaaacaaagtgcaggaggaagcggggatttataaagggttcttttggtcaattcgctctgctagggttgggggtagggagtcagagtcataatttagagacctttcagagacagtgaacagaaatgtagcgtgactccagacatttgaatgaagtttgcacctcctaagacttgatgacctgtctgaacaatctccttggactaaggactagattttgacaaacccagctcagcaaagcccacgatctagcgatcacctccgtaccgccccctccccccgcagaaacacagatgacatagaactgttgaagaactgtctttgctttcctttcgactttttctcatgcatgatcctaaggtgcaacatgccctcatgcgaaaccacaccgttgtgcagacgggagggccataaggatgtcaacactcccaggtgacacaccgggaaaagagttcctttagtctatttcccaacagaaaccctgcttacaaaaatagtcacatgtaacaaacaacacatggattaaaaaaaagatgaatccactaacagagtttgtaaaaaacctgacaaatgtggcagttgaaatgcaaacggtggatagagttactacactaaagtgtttcacattaacccccaaattatagctctgcacccctttagactgatccctacagtctgcatagccatttgtctcttgtcttcagcagtgtcagctggtagttagaacagtaccctcctgtcaaggttatctcccctttacacagtcacagagtttgccgacaagggggtcactgtcttattgaggcactgaccttaaagtgaatttgtgtaaaaacagtcagtttggcattgacttcttaaaggagtccttttgacttcacaggctgtaaacaatttgtcacccaatttattatttttttttgttgtttttgttcatttccctttggctttttcatccttcccttcctgctcgtgtttctccacgattggctttgtcacccgatcgtaggagggcggacaagctgctgtggacattgtcaggtcagttttctccgtaatagagttttcgtttattctgtcaatgagcatgtcttcttttacaagaagattagccccacctttgagtttgttcttattgtatgtgaatgaagcttgttttactgttcgcttcaaaaggtggcgcctataagctcgctgaatgataacagctgacacctcctcttgtttgcgttttaatgtagtagtgatgggctgataagagaccttggaggggttggaagccatgaaccgctcttccatctggattcgaagagcatccatctctccactctcacccaacacccgctttgtaaaagcaaataagatgtccaggcagtggatgcggtctccactcaccatgggcaggtccatggcaatgagctgaagtttgtttggttgtggcaaattgagagggggttctagagcagctgcaaactgagataatttttcaaattccatgaactgggtggcgtcagggtcgaacttctcccagacctcgtagaacatctcaaagtcgtcctcactcagaggctctgcactttcttctgtggcaacgctgaagttctccaggatgacagcaatgtacatgttcaccacaaccaggaaggatatgatgatgtagctgacaaaaaagaaaatccccacagatgggttcccacagtctcccttcaccgagcttccagggttaactttattagggtcacagtcagggggtttgctgttgaggatgggggccagcagtccatcccagcccgcagaggtggtgatttggaacaggcagatcatgctgttgccgaaggtctcaaagttgaacatgtcatcaatcccaacttccctcttaacataggcaaagttggacatcccaaagatggcgtagatgaacatgacgagaaaaagcaggaggccgatgttaaacagcgcaggaagggacatcatcagagcaaagagcagcgtgcggatccccttggcacctttgatcaggcgtaggattcgtccaatcctggccaggcggatgactcggaacagggtaggagacacaaaatacttttctattagctccgcaagaaacatccctgtgggaagataattaaactatcaatcagtgaagaagtcatcaactaatcatttattaaaatatttgagttattaaagttccaatgtcaatttcagagtattaagattcaattttgtaatcttgggtatggtacaaatatattccaatcattttccagtatctgcagctgatttgtcccaggatgcacctctcctccttagaacatcaaaattcaaggactgaaagccctttatatcatatggcagcacatttgcatacaatttgtctataccattttattgaaagttttgaattatatttaaaatgttcatcacatttaacaatgaaagtaccatgtgaagagttgctgtgatattccagaaatccaatcctaactaaacaacaacaacaacaacaacaacaaaaaccaagtaaggctgagtggaggtggatcccagtactcaaaggcagagggaggggatctctgttagtgtgatggtagcctggtctacagaacgagtttcaggacagccaaggctacatagaggaaccctgacttgaaaaaccaaaccaaattaaaaccaaccaaccaaccaaccaaccaaccaaccaaccaaccaacaagaaaacaaacaaacaaacaaacaaacaaaaacaaaaaatccaaaacagaacagttgctaccgttcattatattaaaaatggtcaggagaggagcatggttcttaaaaatacttttgatctgtgtttgaattttcagatatttaatacatacatatggaaaactgagtgtttatagaattatacgatgtataataaaagttaactttagcttttactcagcctcagcaatagattaaaatttaagaatcatagtacagctcgcccccccaagagcatttatttatttatttatttatttatttatttatttatttatttttggtttttcgagacagggtttttctgtgtagctctagctgtcctggaactcagtctagaccaggctggcctagaactcagaaatctgcctgcctctgcctcccaagtgctgggattaaaggcatgtaccaccacgcctggcccgaagagtattgatatgctatggttaacttaaaatctcatcagaaataaatacgaaaatttgcttcaatgtcaacagccaacaatatatgaatatgatgttttttctctaaacttgttgaaccaaacttttctttttcacacttcactaatctgaagtcttggagtgtttcatgctgttttcatcctcatatgaactaatattattacagaattgtccgtgcatgtgcctgtgtgtttgcaaaacactccagggttgatgttcttttcctctcctgtagcaaaatctcaattttttaatttttacagctttttttctccctgtgattttgggttttttggcacatgtatgttcatgtggcatgtgctctctctctctctctctctctctctctctctctctctctctctcgtgagtgtgtgtgtgtgtgtgtgtgtgtgtgtgtgtgtgtgtgtgtgtgtgtcttacctgaggctgatgctgggagtctctttgattgctttctactttatgtatttattttcaatttttaaaatttttattggttattttatttatttacatttcaaatgttatcccccttctcattttcccctcccaaaccccctgcctctataagggtgttcccccaccatcccatcaactcccacctcagggccctagcatttcttttgcggggtcatcgagccatcacaggaccaagggcctccctttccattgatgaatgacaaggccatcctctgctacatatgtggctggagccatgctccatgtgtactctttggttggtggtttaggccctgggagctctgggagctttgggagctctggttggttgatattgttgttcctcctgtggggttgcaaaccccttcagctccttcagtccttgccctaactcctccattgcagtctctgtgctcaggacttctcaattgaacacagagctctctggtagcttgccagataatttgaggggttccaagagccttctttataaggtgtcacccttggccaggatttacactggtgctgggaatctgttctctcgttctcaagcttgcacactaagtgctttagatgccactgcatttctcagctcccccctctgtcctttaaataaagactccattaaagagtacttccaacacaaacacacacacacaccaccaccaccaccaccaccactaccatcaccaccactatcaccaccaccaccatcatcaccaccaccaccatcaccaccaccactgccaacagcaataacaacaacaaaaacctacctattcaaccaaccaaaatacccaaatgcatcattgtatgcaaagcacaaaagcatcattctctttagtcagccttctctatctcagtctctatctctgtctctttcggcctctctctttttgatgctatttacatgattattgttggaattaaaaattacatataacatatgggttggattttagatgtaaggcctatttattcagaggggggaatagcacacagatcattccaactgagtcctatgcttgaaaatttgcaatgatttcatcttaattaggaatgaagttcccatacagggacttcttcacttctctgaagcattgttggtatctgcagtgagatgagttaccttcatgaggctcttatgtactacacaatttgtaggataggactaagaaagagatgttccatgctaccagtttccttctggaaatattgaaaatttctgtatgaaagccacaagaaactactgttagtctacttgcatttcccatttacttctatccatgttctactctgcatgctggtgaccccattaactacatctctaatgtaatgtctttcctgaccttcagaccagattctcagtacccctcttaccagaatcatctagatcagtggatctaaaccttcctaatgctgcaaccctttaatacagtttctcatattgtggtgaccaccaatcataaagttattttgttgcttcttaataattgtaactttgctactgctatgaatcttaatgcaaatacctatgatttctaatggtcttaggtgacccctatgaaagggctattcaatccccaaagtgttgcgacctacagattgagaatcattgatctggatagcgtatagagtgtttaatctcaaccacctaaaagcactttttaaattttggttcaccacatcaatctatttaatatatctcaataaaggagatcttattaatggtcaaataaatatgtgatgcaatgggataaaatatttgtataaattagaagcctaattttggaagaaaaacaaatacaactcaaaaacacatgccaacatattgactttgagtagtgagatgccttccactctaaattcctgttttcaacctccacttttatcaggaggaatttgccagactttgcacagatcttacctacaatggagaggatgaccaccacaaaatcgaaaatgttccatccaatggtgaaataataatggcggagcgagatgagcttgagcacacactcgccggtgaacaggacgatgaacaccaggttgatgcgtgacaaaatgcttgtcacataatcgctctggtcatccgtttccaccatcatggtcaccatgttcagacagatgaggatcatgatgctgatatcaaacacttgtctggttacaaagtcaaaaaccattccttgaaatttgttctgcagagaaacaaagacactttcagcaatgcgggagattcctggtagacagcatatacattaaatacttcctatattccctactttctagtattgtacatagtacctacctattgggacaaatatttgtaattggtgccttgtagaacatttttatatctagttaattaaatttttgttttgaggcatgcatattcctgaatacatcaatcccttgctgtagattctttccctgcacactctttacagaaacacacagtgaatttcaacacatcaaggttacagaactgtaagaaatctgtttgatttgctgttgccaaactttggctcactggctgtagtactttccaatgagcagctagacaatgtggtcatttataaacgtaataaatattagtcttaaatttgctttgttcctagagaattatcaaaggaaccttgtgatttcaaggatgcatctgaaacaccaaacatttacattcctgctgggcaagtagcacttggggggtagaggcaggtggatttctgagccagcctggtctacaaagggaattccaggtcagtcagggctacacagagagaccctgtctcaaagagtaaaataaaataaaataaaataaatttacatttcaccttgacaacattaatttgttcccagcaagtggtctttgctgatattgtcagacaaataatgatgagtctccacaggggtaatcagactgaaaagacattgcttgctatgctataacaaagggagcacatgtccttcgctactcatgtgtagtcagctgaggttaggcccagtacaccatcttctgcttatttctttgggccactgaagaatcctaagcatattttagtaccataaaatacccctgctgtgcagtacttgacttgtgtagcactaagtatcaatggggaaaatgttctcattagacactttgcctcttcttagaactgggaacaaaacacccatggaaggagttacagagacaaagtttggagctgtgacgaaaggatggaccatctagagactgacatatctggggatccatcccataatcagcttccaaacactgacaccattgcacacactagcaagattttgctgaaaggacccagatagagctctctcttgtgagactatgccggggcctagcaaacacagaagtggatgctcacagtcagctattggatggatcacagggcccccaatggaggagctggagaaattacccaaggagctaaagggaactgcaaccctataggtggaacaacattatgaactaaccagtaccccggagctcttgtctctagctgcatatgtatgaaaagatggcctagtcggccatcactggaaagagaggcccattggacaggcaaactttatatgccccagtacaggggaatgccagggccaaaaagtgggaatgggtgggtaggggagtgggggggggtatgggggacttttggtatagcattggaaatgtaaatgaggaaaatacctaataaaaatattaaaaaaagaaagaaagaaagtagtgcttgaactggacagtagtagagcatgcttttaatcccagcactggggaagcagaggcaggtggatctgagttcaagaccagcctgatctacagtgtgagttccacaacagccaaaactccaaagaaaaaccctgcctccaaacaaacaaacaaacaaacaaacaaacaaacaaaattggctagtacaatagaaacattcactaagattctgttttgtaattcatcatggggaatattttaagcttaagatcactgccatagtcaaggacaccacaagaagacctacagtgtcaactatcctgggaccgtggagactcacaaagcctgggccaccatccagggagcgtggtggagctggatctaggtaccctacacatttgtagcaagtgtgcagcttgtcttcatgtgggttccctaacaagctgtctcagtctctgcttcctgtcactggagccccctcctcttacctagactgccaggttagtccttggtgggagaggatgtgtctagttctgatgggactagatgtcccatggtggagtggtataaaagggggatccccttctttgaggacaaggggaggggacaataggaagaaggatttgttgtgatggtgggactaggaagagaggagggagggaggctgtgattgggatataatgtgaataaaagaaataagttatggaaaaaaatcactgtcataaaaataaccatgataagggctctttctcctttatagtttgtagatgaatcttggaaatatgagaatggttatttattatcacaaattgtaataatgccgacataagcaattgctgattttagagccatacaaaaacatattcattactgggatgctcacctcctctaaaatggtccatatttctacttattaaacaacaattacaagtggagatgatatgccattgagcatcttttctacctctttaatcagaaagtaaatgaatattagccccaccctatgcttctgtattgcttgacattgcactgcagctactgtaaagtcataaagacacaactattgtgaggaccacattagtctacgtagtttggattctaagtgtgtagttgtaggtcatttggagacaaatttgcattttctgtatattcttattctttttggtctttaaaaaaaatatcaaaacatagattagagatactcaaaaggttttttttttcctttttcttttttcttttttcttttttcttttgtgctgggaatggtagttgatttcccctgagaaacaaaactcatttcaggttgttgctttatattattttcatttgatatttcttactccaggtcgagggataggcttttgtggcttttttgatcctaatttcttcattgcattatagtatttcttctgttcttctgtcataaagatgtcttgacctccaaagtatagaaaaaaaaatcaaagctggttaaaattgtatccattccctcataacttttcaatattataacaagagatttcaagagattaacatggttatccttgtgacttattttgaatttgaaaattaaaagtacactgtattgactataatacttaagttttaagataactaaaattggcattattattataattattgaaggaaaaaagcccagacatggtaaaacacaaagctccatcttccttctggcccacacttccacctacagtcagggaccagcaccctgagctctccttcacaacctgtctgcctcatgggagttcttctcccaccagaacaaccagctccatgtttcagtccacacctctacctgcaattggggatctataccctacacctcagccaacagctctgcttgcctctggggagggctttagctatctaggacaacaagtctctgagagttactactcccaaggacttacaggccagccaacaccagagaaaaaaatagatggcgaaaggcaagctcaatagaacaatagaataatcgctagaagccagtgcagtatggcaccttcagaactgagctctcttactacagcaagccctggatatcctaacacacctgaagagcaatacttgaccttaaatcccatcttatgaagacaatagaggccattaaagatgatataaataaagcatatgcagaatataggaaaatacaactaaacaggtagaaatctttaatgaggaaacaaataaatcccctaaagaaatatgaaaaatacaatcaaacgggtgaaagaaatgaataaaatggactcagatttaaaaatagaattagaagcattaaagaaaacacaaatggaagcaaccctggagatataaaactgaggaaagagagcagggactacacacataagaatcaccaacaaaatacaagagatggaagaaagaatctcagacagaggaaatgcaatagaaaaaaattaatacattgataaaggaaaatgccaaatgaaaaaagttcccaactcaaaacattcatgaagttgtgatacgatgaaaagactaaacctaagaataatagaaataaaagaaggtgaagattcccagttcaaagggctaaaaaatatcttaaacaaaactatagaagacaactttcctaacctaaagaaagggatcactatagaagcttacagaacatcattagattggaccagacaagaaaattttccttccacatattaaaacactaaatatatagaataaaagatagaatattaaaaactacaagggaaaagggccaagtaacatataaaagcatacctaatagaattatacctgacttcccaacgaacctctaaaagtcagaagatcttgcagatgctaagagactacagatagcagcccagactattatacccagtaaaactttcagtcatcatagatgaagaaaccaagatattctatgacaaacccaaatttaaagagaatctttctactaatacatcctataatggatactagaagaaaaactccaacacaagaagagtaactacacccaagaaagcacaagaaattaatcatcttacagtaaaaccaaaagaagagaatcacacacacacagaaccaccactaacatcaaaataagaggaactaacaatcattggtcattgataaatttgagtatcagtagactcaattcaccaataaaaagacaggctaacagacacgtaaacaatttccatcattttgtggcatacaagaaacacacctcagcaacaaaaaaagacactacctcagaataaaggcctcaaaaaaagttttccaagcaaatgaacccaagaaaccagctggagtagctattttaatagctaataaaatagactttcaaccaaaattggcaaaagagatggggaaggacacttcatactcatcaaagggagaatccactaagatgacatctcaattctgaacagctatgccccagaagcaaggaaactcacatttgtaaaaggaactttactaaggctcaaatcacacattgaaccctacacaataatagtaggaaatgtcaacatcccactttcaccaatggacaggtcattgaaacagaaactaaacagagaatcaatgaaactaacagaagttatgaaccaaatgaatttaacagatatctaaataaccaccccaaaaccaaagaatgtggcttctactcagcacttcatgagcattttctaaagctgaccatataattgggcacaaagcaagcctcaacagatacaagaagattcatattaccccttgcattgtatcaggtcaccagggattaaggctagacttaaaaaaaaaaaagaacaacaacaacaacaacaacaacaacaacaacaacaaaaacccagaaataacagaaagcccataaacttatggaaactgaataactctatactcaatgatcactaacttggtcaggaagaaatagagacagataccaggtgccaaagttaaatcaggataagaataaccatctacacattcctataacccctaaggaaatagaagcaggcattaaacttctcccaaccaaaaaaagtacagggtcagatggttttagtgcagaattctaccagaataccaatgctcctcaaactattccacaatatagaaacagaggaaacactacctagttcactctatgtggccacagtcactctgatacttgaattacacaaagactcaacaaagaaagaaaactacagaaccattttgtcaatgaaaattgatacaaaaataatcaataaaattctcccagacccaattcaagaacacatcaaaaacatcatcaccatgatcatataggcttcataccagtgatgcagggatggttcaatatgtaggaatccatcagtgtaatactagtactccccaaattcttccaaaaatagaaacagaagaaacactacctaattaattctatgaggccacagtaaccctgatacctaaaccacagaaagactcaacaaaggaagaaaacttcagaccaatttcacttatgaacatctacgcaaaaaacactcataaaatattcacaaaccaaattgaagaacacgtcaaacacataattcactacaaccaagtaggcctttcatcacagggatacagggatggttcaatatatgaaagaaaatctatcaatgcaatccactatacaaacaaactgaaagaaaaaaatcacatgatcatcacattagatgctgagaaaacctttgacaaatccaatactcctttatgttaatcataataaataaaaaatgaatgcaacgaacaaatagtatgaaatcatgggacataaagaaatataattggctgggatgaacttggatacatccaaaactatttgccataaaatgcacaaaaaataaagttaaattttgtttccctttaagagatgtcaaatattaacaactaaagggaatgtctggtgtctgtgagagtggtggagcaaggtcatgctcacatagcttattcagttgactagttatttaactacaaggaggcaatatacttcactctggaatttaatgtaagaaaagatttaaacactcaaatgttttgcaggaaaaaattacttaagtcactaaagattagatagattgaaattggccaagttatgataaataaacatgaacacttttaacaaactgagaaatctctgtgataaaagtatttaaaattgtacattgggaaacatttcagggctgggaccatggcttagtgcatataggcatttgcttacaatccaaatcacctggattcaatccctgggactcaaagggtggaaggagggagaccatatcctgtaagttgtctactgactaccacacacccagtgtggcatgaataaataactgtaattttaaaaagtatttcagagatggctgaagtgataaatttattacacattggcgtgaatataagctcagatcccaacccccatgttaaagtgggcatggcactatgttattaaaacaaaaaccaaatggtgatggggatgcagagataagatgaatccattaatctcactggccagccatcaatctgaattgaagaggagattcaatgagaactcctgtcttaaaaattatggtgggtagtgattgagaaaggtgactaatgtttatcactggcttttacatgcatgtgtacattcatcctcacagacacttgcacacaccaccacgaatacacatacaacacaacacaatacaacaacacacacacaacacacacacacacacacacacacacacacacacacacacacacacacacacagagccacatatgtacacagaatatttcagggtcagacaacgtgatatgtgactatagttccaatttatttgagaaggatacagggctgctacttgttttaggtcacatagggccatatagtgagatcaggtcagcctagattgaaaagtgagaccatcttaaaagaaaaaaacagatgagaagtagttcaaaaaaggagactgttcatggaaagagtttgagcagacaaagatgaaatgtggaccattgttactactgagtgataatatttgcatgcttcctttagtgcacatatataattgaaataatcaaacatgccttaagaatgataatagataaaacaaaaattcctcaaattagaactagaagtggttgctattaattaaataaccagaagaaagaagtacaggtagaaaagagtacaaaagaagtatatacactgaaccgtattttaaatgatggataattactgactatgtataatcatgggatttagtgtgatattgtagtacagacatgccagtgttctctgatcaaatctaaccccttttccctcacctttccacatgcttttccagcctctagtgatcttttagctgcgaataccttataaaggggagtgagtgaggagttattaaggataaaacatagggaaaaggtcgtgagctatttggtttctgaattcaagatctcatcttgaattccaattcaaatagaatgttaattactctgattccttgtgttaggaaaaattgtaaaaatacttatcttcttcttttgctggttgaaattgtcgataatgacaccaataaacaggttcagggtaaagaaggacccgaagatgatgaagatgacgaagtacaaatacatgtacaggctttcctcatacttaggctgtagttcaacctgccaacggagggaatttgttaactgataaagcagtttgaatactgggagcaagtcggtgcttctacacaagagtagaaggctatatatattcttagaaataatttagtgtattttattcccatatcaacagcctcaaagaaacaaaaaaccaaaaaccatccttgaaactaggaagcaaaaagtttttgtgtaaaaagtgatgcaattcgtcactctaacactaattgcataattttacatagtataactgacattctgttatttggataatagactttagatttggtaagttttaagttaattgattttcagtaatttgaaaatactagtgtggtgtcttatgtctgtgcaactccagaatttgggaagctgaggctggagacttgttgagtactattctagcctgggccacaatgcaacatcctgtctttaaaacaaccaaagaaaaagttagtgaaaaattagctcttataaatatagagaggacacttttatagtcaagattcacttgtgtatgaacttatatagcaaatgaaggaactgaagtattcatttggatgctggcatcttgccctaccagtaacaaagtcattaaaatttttggattgaatagacacgttcaatgatttattttataaaatcctccattgacgactgactctcagacttgcagttataaaaatagacacagggctgtcactcaatgcataacaatggagtcaatatttagtataaataggtaactactgcagtcttctatttttaaagacaacagctaaaattaactgaacatctaagacaaactctatgcaacaaggtgagatgatgcaattccagaggtgatcaagaagtttgtaggggaacaggacgatttcaaatttatcattgtctccatagtaagctagaggtctgggttaccgaagaaaaccaaaacaagaacaagaataaaaaaacaaaaacaaaaaacaaaaaacaaccaagtaacaggaaagaagaaaacagagattttacagttttggagatcaatcttagaggaagcctgtgatttttgagtacatctgaaagctaggaaaagtatggaatcaataaagtagaaatgataacagtgttggtacataggaaagctaggaaaagtatggaatcaataaagtagaagtgataacagtgttggtacatctgaaagctaagaaaagtatggaattaaaaagtagaagtgataacagtgttggtacacactccagtgaatgcatgggtgctgttcttataaaggatggatttagaaaagactatgacacatttctaagatgtttagcctgcatctttagcctttcaggcttcaaagcatggagcctgcctacacagttcagctactgaagacagtcatatattcttctatgtcctttatacaacaaatagaaacactttggagaatatctgttgcttattaaatgaaagagttgaattttttctttcattttttgacttccatttttttttctgaactcagtacaatatctctgatagacactgctgtgttaagtacaaactcaatatactgtcttcctattttttaattaactaaaatggagttagtttgtttggctaattcataagctaatttaagcaccaaatcaatatttccagaagacattggatataaaaaatacttacatttctggaatcaactgcagcatacatgatatccatccagcccttaaatgtggcctgttggaaaggacatgcatgccttaatttgggttaaatttcaaaactgatgcttactaatatccttactgtacatgtttaaagaaatattttaaactattttcaaaacaaactttccttggattttgaaaaaaagatagaaagccaacaaaatggcgatctgatataacttcctattttccaaccagctctaaagtaactctcaagcttaacattctattacaatttggaagaaagtcctagaaatgtaagtggacttggcagtgtctacagcaagaacaaattagatctgcgatattctgtgggaatctcgtcttctaggtgatcaagttgacagtatttaaggtttttctttatgcttacagtgtatggatcatatgggcataaagaaaaaacctgaagctattcttttaagaatttttcagaaataacactatattcattttctatggggtaacccctgaaaagattgtgtaaatataattaacaacataataaaagtgtgacaaaataggactgacacttgtcatttgcacattgatgagggattcctcctctaacctcttgcaggcatttgtcatgtgtcttagaacacaagtttgaggctacaggacctgaaatatatattccatagtcaatgaggaagcctcgcatatttttgtgatttatctttgtatttaaatcattgactcttggaaaatgtgggagtgtgaccagagactaatgtatcttagtcagaaaacggaaattcttttcacatcaaagagagagatgggtgatgtgtcagtggcttagaccaattatagaacctgtctatcacacacttcctacaggaacagaaaagtgatttgacctatttctatgaacttactcatcaacagagaggtgggcgaaatagtcaagtgtgaaatttttacttagtagcagaacatgtttgagagttctgtgcacttatctggattcacaaatttgtactaacagatgataatgctgaaaacatattataaagtttcttcctaacaaaataacagctgcaataatcactttgttattattctgagcaataaaaattttcagagaaaatagtgttcacttacaacttgaagcaaagaaagatacccaaatcctacattatcaaagtttactttcacatttttccaccgggcggtctcatttctttctattagttttaggcaatcagaatgattattgacttcgctgatctcaaatatgtcaccagttgtggtgttaacacagtggtagaatttgccagcaaacaaatttacgcccatgatgctgaaaattagccagaatataaggcaaaccagaagcacattcatgatggatggaattgctcctaacagggcattcacaaccacctaatacacaaatggagagaaagagaagtcagaatccttattgattaaaagcaaaaagacatccccctaggaatcattgatttattttctatcaagactacttatcctatctgtgtaagagcaaagcagaaataatcttaacataaaactcagtcttttttaaatattatgcttaggaaaagaaatataggcaatatgcaaagagatggagaaaagaaagaaatctaatataaaaaaggtgctaaaggaaaagcaaaatgggagaagttagctcctggatgaagacacatgtgtagtttattagaaaaaataaaaggaggagagagaagtaggaactcctaggcaagagattagctcataaaaaaaaatcccaaaacaaaacagtatctcaaagaatagaactaaaacatttgggcatgaattgattggaccaatatactttaaatataaattaaaattcagatgtataaatataaaactatttttaacatctaatatatttttggccttaattatccatgcattgctataactaatagtagtttttgcataagaagcaagacaatttagcatcatgtatttcagtagatcatcacatcgtttatttcaagctccagtcatgtcagttgtttcatttactgagtttaattcaataaacttatcttaaatgaaacactagagagatcattttctcaggaaaacaggaaaaagagggatgtcatacgtacttatcaactctgatgtgactgagtaaagtcctgtgctaaaatattttctccattttctaatgtcaaagatatttccctctctcttgtccttaattcgggactacagatttaaaatgggattttttttttttatatttgacatatggtagtcttggcttccttctctatagctcaccattgaactgcacattagtaactaagagggagataaaggctggccctaatgtgctcttaattggcaagtgtgtttcagacttgaacatggacgtcagattaattctactcatgttgggggagggggggcctgccacttttgttagtttaattatgaatatcatctctttgatttttattatagtataattttagaagtttttgcctgtctgacagaagtataagagccaattccttgtacttctgagccctggctgaactttgtaaggaacaatatccattggggaatacaaaatagtgggctatgtggccaagggaaatgaaaccagtaacaataaagatgagggatgaacatgaagaagataattcagagtgcgctatcaaggcagaagccaaagataggctgatgtgtagaaattaatgagcaactatctccctttatggcctccctaaaaaattagcacacaggctttcctgtatatattactttttaaagttattttcaatttaatttttaaattattaagaagagatttaaaaacattttaatgtaattttttaaaaaattgtacccctaaagttgtttattggatttgagatatgaacactgaaattgagtagttgtttctcatttctgaatacttcatctcccactcacagtgaggtgctctgtctgccgaggatatgaaatccatactaacatgcaagcttttcacttttaacactcatgacactgaacattttggtacaagtctgtaggtttcatgctgcttccttcaaacctttccaccttggccattggccctgttctctatcttcgctctgtcctcggttactaagaattacattcttatcagattttatttgcttgccttctttcagtatggatactaaatttatctatcccatgtcccattttgaaaaattccttaatggttctctagccattagaaaacatttctctttctttggcatttacatcactcgacagtttgtgaggttattttcctcaaaacagtttgcaactatgtttatttgtgtgtgcatgtgggcatgcatgcattttctatagcacttgggtggaggtcacaggaaaatttgcaggaattattcctctcctttccaccatgtggggtcagttctggggattgtgctcaggtgctagacttggctgctgaaggattctcacaagcctgatacatttcccctttcagcttccctaactggtgacatacacttcaccctcctctgtgacagtcactccacgctaaggtgttagtctgagaattgagagccttctttctttgaaactccctgccaagtacttgcccttgaaataatctccctcctccaggctttagctcaaatatacatgtcgtttattgagtctaactctacacatccttaacaaagatgagagtgtttgccttcgaattgaggaattataatttagtactggaaagagcaataaggacaatttggtgcttggggttcatttggaaaattagactaatgaaggtaaaacaagttaggttcagaaagtagaccagaattggcatctcatactcttttctgtttatcctgcaagttttttcaagagtttcaacctcttatggttttctctgactgctctgtgtgaaagttaaatattttcttatattccaattgttagattatgatgcttcaatgtgtcaagtgtacatatgtgtgcaagtgtgcatgcacatatgtgagcatatatgtggaagcatagagctgtatgggaaatacatgtatagatgtagaggaaagagatgtaggggtcggggggggggattctttcttatttattgcaccaactgaattcagagcttgaggacagggctagtttcatctttctagctctggaattacatgtaagctactatgcccatccgacatttctgagggttctggatatccaaattccagtcctcatacttgcctggctaaggatttaaccactgcataagaaagcagtttgcataatgtaataaatgggagagatttcctttgaagaagggactggttttgaattaaaagtaatgcccattagtgaattcaggatggcaaatactatataggaatgcagttcaggaaaacgtgcaaatttgccatagatttggcccagtgagacatttattttacaaggatgtttgtcttagagaacatttggcataggatcagaggatttgccactgaaaatccacttaaagttgcgatttcattaacatccagagcaaaagatcacaaacggattgcctctcccaagagcccaaccatcccttggttctacaatattaattctttgcagtctctagggagagtcagtaattggctcccatgtgggatgcgctgggaagtgttggtctaagtcaattggaaagaacacattgaggttataaggtacataaaaggagatgtctaagagagaagtatgcttaatgggtggattgtagaggttgtctcttctaacaatgttttaaaaggacatctcccagcagaatttctgtattgtcacacaaccagttcttcaagtctatttcttctttagggttcatactttttattaaatcagtgaaaaattaggaccaggcaaatattcttgttgatattagaaatttcagtgcatttgaaagtatcatctaagtgaagacatttagattagttttttaagtcaccggaaaccatgggttctatagcttttctaagaaatagagaaaaaccatatgtgaataagaatttaaaaaatggaaagtaaaaatcatgagttcttaatatgaaatataaaaaatttttagaaaagccaacaactaaatcagtgttgtgaaattttattaagataaatatttttgatagataaatgcctcaattatccaaacaatttttttttcttccaaacaataaaaattatctttcttatccaagactcctacattttaagaggaagcagaagtgtcagtttggctttttattttggggtgcactgtgatgccttctaagattctgggaagttaattggggtagcttacaaggagttggcttatacaccaatttcttagtgctcatgatttttttgtttttcatgcatatcctattctttatacttcaatgaagttgacttttcacatgttttggttttataacttaaagcacatctttttttttttttgtattcccttgtttcacagggatcttgccttgctactttctgcaaataacacatttttatgcaataaagatgagaatgatcataaccattggcaaccctgagatacctggcctgttgtacctttagccactgctcgcacacatcaacgatcaactgatggaatgtgactggcccattgagggaccagagcagtgtgttgaaaaaataaggactatatgctctgtcactaccatgagcttgacaaatgaaaacgttttcatcagcatcctacaccagggtcccccaccctcaccaattgagtaatttccccataaatggacaatgaagtataaatagctaaatcatattcagtgaaacgtaataaagatatgtacttctggggttataatccacagatggtaagtcagagataactttttttttcccaaaagaagtttaagctcattaaaagtagtggatttggaaataaatcctgtattgtccctactgtggtgcaattgtacccttcccactccctccctcaatcccactacacataagtcacagtgcaaggattaaaggtagcaaaaggggtaatacagtacccataataaagggctgaggggaggaaccaccgctccaccccatccaagttggagcaagattatcctatataaaatagaaatatatagtttattattagttagaaagctgatatgacagaacatttggtgttactttttgtatatgatgctcactgcctgtttccctagcaactaagacttgagttctttggaaaaggtttttacgattttcccagcttgggaaattaaaactacgaatttaaatacaagttttatttgaccctaggtattcacgacatcggttcattccgttcaatttcacaagttgaaaaaaaaatttggactggaaatttgaaatacaataaatgttcaaaagctgtcagccaaaagtgtgcataagacatgcaaaacacaaagggcaacgtgatgataactcgtttgttactttctaactccttctcaagcactatgcagcatgctgtgtttggtagtgttgcgtagaagcacatgctttgaaagagtgacaaaaaacccaaaacaaaatgactgcctggttgacactcggacacagcgattgcggttctatgctgccaaggaggataaagtgagagtttctgaagatactctagctcacttcccgcttacaatcatcatcatgcccaacctcgccgccatccacagttatatactcttacaaagtagaaaatgtctcatactagaaatacaaaaaccagaatcaacagaaggttggttttgacttcacaatgccaaactggtggtgaggaattgccgtgaccttgagatatttgtggtctcactatgtgccaagctgaccaaggagtcagcttcgtaatatctacccagaatttttgttttgatgactccagttttaaaaaagagaagcatatcaacaataattgacaaaagcattattaacaataattgataaagttatttctacacaaaaggaaaatagactcatttgttatggaaagtcaatattacatataaaaaataaacgactggatttaataatattctaaaagatcaaagttgaagtataatctaacaaccttatatacgtagcattattcattaaaggcctgacactattactgatgttatggtgtgctgcttgtaggcaggagcctagcatggctgtcctctgagcccctaacaacagctgacagagacagatgccaatatttacactcaaccattggactgaagtctggatacctgtggttgaattaggggaaggattgaagaagttgaaggggagggtaactccataggaagaccagcagtcccaactaacccagaccccagggagcttccagagactgagctaccaagcaggaacatacacaggctgggcagaagcagaggactgcctggcctggtctcagtgggagaagatgtgtataatccttgaggaacttgaagccctggggaagagggaggcctagtgagggagggagcatcctctcagaggcaagggggaggaggaatgagatgagaaactataggagggggacagggaggagaggtaatggctggattgttaaaaaatgcgaaagaaaaagaaacataaaaaaaccataaaaagttgaaaaatgtgaatttaaatttagctcatgtatttttatataaaatgtataaaaacaatgttttccttgacaactgaaattgctattctgaaacgaaagtgctcttttaattggaaaagcatttaagttttgcataattgggagaaaatttatgatacatttttaatacaaatgtgatttcttgtgtgagaatcaaagctcctttgtgcttacttggatctactgaagagaagttttcatatgtgctagagaaattaaaaattggacaggtttcttacagtatagtataataaaatttataataggtttttatggggggacacaggctgaaagccctctatgtggtgcagagaggagcctgtttgttggagccttggtttgtaagtgtcaggacaatgagcactctttgccttatacatttcatctgattggtttaaagagcgtaaattttggatcttaataaaaaaataattttcacacggcacatcttctataaatgattgtataatgctttgaaataatcatcataacaatgagccaataaatgcaaaaatctgatacgtgttgaattatggagaggggaataatgctttgctcaaaagagcaacataaaactctgtgtaactgagaaccgaggtttaagttaaggttgacgagccatgtatggcaatgaataaaaatacatgttctttttccttatcagctgtattgtcataagatgtgtatgtatttatagtaattaaattagtgtcttacttattcaatgtcattaatttagttacagttgaggcagtattattatactccagtcaatggttaatatctgcccttggatatattcaaataatgagaattttggcattgtaaagacaaaacatttaacaattcttcattttttcctttgtattcatacacatttgtgattcacattactttccataggatcccttaagtactgatgggctgtcatagaggagaacgatatgaaacaaaattatctctaggtaattattacatgactcaacttagttctttaagagagtatctgcccctccccctttgtattaggaattataaggaaactcccaagatcgattatgaactaaggtcattttaattagcaaagcagataaatgatattaaatcattttcaaagaggccgattttctcttgcatatcaccaagaagtaaatatgcaacagagaaaagggtaaagtagcaagtttgcaaagggttgccattccttttgcatgcacgtgtttttcgttagttaagttgaactcagcctagctttgacaatatacaacgctgcagagttttcctttttcttaccctcatcccttcaaatcgtgataaggctcttaggggtctcagagctcttagtgtccttagggatttgatggccccgagttcagagtaacccaaggcatttgctgttaaactgaccaatgaaacctgtacaatacaaataacaatgaatcaataacaccgctttcgtccaatttgcagttatcaactaatacaacagataaagttttattcatagctgttctgttattctactgaataaacacagcaatagtgactcctaatgatgaacggctttatccatagatcactgccccacctaaccctcgccagagaagctctctcttgcagtaggtgatggttaacagggacccacaactggacagtgctgagtgagagtccttggaaagctcagtactaaataggatatcttcatgaaacccctcctctcactccttagagagctatgtggaagaggaggctaaagagtttaagagcacttgttggcatccacaataatgtctgggtttggtagctgtatatgggatggatccccaggtggagcagtctctgggatgtcaacaagtgcttgctgacaggagcctgatatagctgtctcctgagaggctctgccagtgcctgacaaatacagaggtggatgctctcagccaaccattgggctgaacacagggtccctagtgaaggagttagagaaaggacccaagctgttgaaggggtttgcagcaccctaggaggaacaacaatatgagccaaccaggacccccagagctcccagggactaaaccactaaccaaagagaacacatggtggggactcatggctccagctgcatatgtagcagaggatggccttgtgggacgctgttcctatgaagcttctataccccagtgtaggggaatgccagggctaggaagctggagtgggtgggttggtaagcatggggagttgggaagggataaggggttttcagaggggaaacaaaaaaaaaggggataacatttgaaatgtaaataaaataactaataaaatttttttttaaaaaagtttaagagctagaggtggggagtgactccaagaaaattagtgtcttccagatacaacagggtgagggacatatgagctcacaatggtgacagacttgacggacaagacttgtggaaaatttaaactggactaaattgtagcgtgggggaggggaggtgagcaggaagtttttacccctaaccaagatgctatttgataatgctgggagagaaaaatcagttttcctcaagggagtgacactgggtatatgaaccacactcagggcagtctgcaagagcagaagtagctggtctacccaaatgttctcgaatttgatttttgtttgtgtgctcttattttgttgttattatggtttagtggttggttgttttcgttttttttttttttgttgttgtagttttttgtttgtttttgcttgtgttttattgcttatttttttattttcttttttcttccctttcctttcctttcctttcctttcctttcctttcctttcctttcctttcctttcctttcctttcctttcctttcctttcctttcctttcctttcctttccttccttcctctctctcttccttccttccttccttcgttcttcctttctgtctgtctgtctttctttttctttatttctcttttttccttccttccttccttccttccttccttctttctgtctttctgtctgtcttccttccttctttcttttctttctctctttctttctctctctctctctccctccctctctctctctctctctctctctctttctttctctttcttccttttctttttataaagagaatggagttgtcaggatatcaagacaggaggatctgggaggacttgggggaaggtaagcaatataatgcaaaatacaccgtagaaaaatttacactgtatgaaaagtttaaaagtaataaaatattaaaaggacataaatgaatatcaagagtaaagaatttgcaaaataccaagtcctaaccccacttggagttatgaaagcataagctaatgcctattgattaatttcctctctcttttctgtaaaactgatgactcctttgagatttccatcaatttgctcactccattttggcctcactgagtggccctgttacttgtttttaagtattcataactaaaattctccataactcactattctcaaattctcactattcataactaaaattctccataactcactattctcaaattctcactattcataactaaaattctccataaggatatttggtacatcaaggactctgtaaatctcatttacataaaagaaaatttcttcctcatcattaagtaggtttgttttcccctaccctctgtaaccttacttgtaatagacttaaaaatctctccgtaaaatcttccagtagataagaaagatttataagattacaatagtgctcaccatcccttctgtatcttgctattatttaccactggggaagaacatcaatgaataagtgcatgaagacccaatctggagtcggtcaagtttataacatggcagaatagacaccataccttttaaatgtctttttctatcatttgcattatatattaccaatatcattgtttaaatttggttttcctactagatcttatctcctctttttaaattagttagtaaattagtccagaacttgtaagttctatgctattattaggtgagagagtttagggctggggagcctatcttgtcatcacaacacagtggcccgagactcattcattggtttagaattgggatacaaacaagacaaactccctcaaacaaaaggcacgacatggaaaatacctacatcaacaattaagaagtctagccaacaccaggcattggtgaagtatgtttgatagccataggccacccatttgaggagcatctccaggatgaaaatgtaagtgaagactttgtcagcatactccagcatggttttgatcgtctttcgctgatcaatatatatatcctcaaaggcctagaaagaaaaggttacacattttagctttcaaacactactagaatcttacagctagctttttctgattatatatgcacatggtatttccttgggatggaagaacggggatacagtattgctattgctttgttactctctgagttttatccttataaaccagagagaaagatatactttagatagctactaaaaccagagaggggggaggtgtcttcatgacttcactcttcctgaagtgaaatggtaatttcctgagtcaattggctaagccaggatgtatttcttaatgtcacattccatgcagccatggcgtgtctctctctctctctctctctctctctctctctctctctctctctctctctctttgttattggatattttctttatttacatctcaaatgttatcccctttcccagttccccactcttggaaagcccctatcccatcccccatccccctgcatttgtaaggctttgacaggcctcataggagagagctatatcaggcttctttcagcaagcatttcttggcattcacaatagtgtctgggtttggtgactgtatatgggatgaattcccaggtaggacagactctggatggcctttccttcagtctctgctctatactttgtctccatatttgttcctatgagtattttgttcccctttctaagaaggaccaaagcacccacactttggtcttccttctttagtttcatgtggtctgtgaattgtatcttgggtatttggagcttttgggctaatatccacttctcagtgagtgcataccatgtgtgttcttttgtgattgggttaactcactcaggatgatattttctagtttcatccatttgcctaagaatttcataatttcattgtcttaatagctgactccattgtgtaaatgtaccacgttttctgtatccattccactttttgaccttagccattctgactggtatgaggtagaatctcagggctgttttgatttgcatttctcttatgattaaggatgttgaacacttttataggtgcttctcagccattctatattcctcagttgacaattctttctttagctctgtaccctgtttctttgtttctatgctgtgggtgtgactcagtggctagaacagttgtctacgtgagaccagtagcttgacttccagcaaaaaccaaatttctctcattattatgttttttttataggagagagattaaatcaataagtgatttatcaatatactgtccaattttattttactaagcagttaactgcttttttggggttttgttgataattctacttctttactttttctttcttttcttttgtttgtttgttttgtttgtttgtttgtttgttgtttgttttacaagacagggttactctgtataatagccctggctatcctcactttgtagagtaggctggggctctaactcacaaacatctgtctacctcttcctgatggaattaagggtgtgcaccaccacatctagctgataattttactttttggtacgtatagtatgacattacttaataggaatgtcatattacttttcaattagatccacctatgccttttcctaacataaacctcagctggtaatttacttctaatatatatttctttcaatgatgaaaagtcatttttgtctatgatatgcagatatgtagataatgatatgtagaagacagttattccatcaacaattttatagaaaaatatatacttgattttaaaacttgtaagtcattgtgttttaatcaggcaaacacttgtgcttatttatttatgtatatattctatcatttatctaaatctatatatcatctatctatctatctatctatctatctatctatctatctatctatctatctatagtttctctattatcaatctctccaaacattttattttatgacttcaatatatttttatatctaaaattctgtcaatatagttgtatatatgtaaacaattttcatctaaatttaaatagattctgatgaaattaacatgtttctataaacataatccagtctttaagtaatcacttaggtatggtgcccactacttagcattaccaatatcatttgtttcctgagtagcccaagaatagtgaacacacatgaaaagggacagagaagaggtccccaacgacctaccaagcttccacaaagagttcatcagaactcagaggatatataaccactataatagcactaacatgaactctgatgtgctcctcatagtcatgtttagttaagcaaagaggaatattcactttgtttataatgactaagcaaaagggacccgttttttttgatctgtttcatgataagcaaacatcgatgaatgattagaaatgtgtgtgcacacatagatgcaaacccagaaatgcagctagtcattaactatctggcaggaagataaaagggtgttgttattgaagactcattgataactaaggcaatgggaaacaaaggcttaaagagtgtgagattttcccagttgctactgaagcactttgggttaaggttcactcaccagggcaccactactcaggagaatcatgaacacaatgaaggtctcaaaccagttgtgttcaactattcggaagcacgtcctccgtaggttccaccactgtttccctcttccttcttccacgctgatttgacagcacttgaatctctggacacagcctgcaagcatacggttccaataggagtatgaaagatagctctaccacctccattatacattgcatcagcccagcttcatccctccaccaccagcgctattcctaatttgctttaacttttaaaaagtgtgtaatttataagcaatggcaaatcaatgaaaacatacagcatcttcatattttgccttttctctgacacaatgttgccttcaaagaaaactcattgtaaattacaaataacgacatgtagtttgccttttgtggttgttcttttctcatctctctctttttttttattttaattttaaaaatttctttaatccttttttatagtccagtatttatcccactcctggtctggccccttactgctcctcatcccatatttccctaccctagtatgtaagaggatgtgcccacccacaccccaccagacctccccactccctgggacctcaaatctctcaagggttaggtgcattttctctcactgaagctagaccaggaagtcctctgctgtatatgtgttgggggtctcatcagctggtgtatactgcctgttggtggctcagtgtctgaggcatcttgggagtccaggtcagttgagagtgctggtcttccatggggccaacctcctcctcagcttcttcctgcttttctctaattcaaccacgggagtccctggcttctgtgcactggttgggtgctagtatctgcatctgactttttatggtctgaaattaatgcatttggttggagctactctagaaaagggtttcaaaatgaaattaatacctggacagaaacctcctctcctaagtgtgtattcttgtggtgctcctgaaagggtgttcctggtttcctaagttgtctgagtttgctaacaggtgactttcctggacttgctttgatgtgtcttttacgtcctcacattgcttttatatactgaatctagcctgtgggcctcactctctacaaggtctattacatttaagccacccactttgggtgatcgacagttgaaaaggccgtactccgtatgaactgcaagcgatgtcacccgcatctttaccttcagtgaagcaagcttcgggctcaagggtttcttctggttcaatgacaggctgttcctctgcaggcgccccaatgtctactgtgcttccctctgaggagctactgctttcgttgagtttctgggcataaaatgatcataaaaagcaaattcttttaatttaattccccaatgaatgacataccaagaagggattatttttctcaaggtaaggtgctaatgtaaattgagagtaaaacgaagactcagaagaagagggaatgggaaaacctaactgttgattcctaccccaggaatttctgtgtgcagattgctgcgctgtgctgggatgtcacaaattgaccatcagcaacatgtagtgagggaactcctatcccatggattggggaaggagagagtgtcgtgacttgtaggaatggggagagagataagggaaatgaagctcggagaatctctacctgagaagaaaataaaaccattaagctagtctgtgtttaaacatttacatatgtttctctaatagtgtctcaattctgagaaattataacataatgctttaacttacacttcctgttagaacagaggatcagaattatttattataaatgtattcatatttttatatttcatatgccttttggagaaaaggtgttttacaataagttaaaaatacatcaataaacaaatagccttagactcttaattaaaggggttcattattggaaaatattttcgaacctaaagtgttgcagaaacagaccaataaatgcatggaaaagtcagtttccgctcaacaagtaacacactaatatcccacgtaaagctaattcaacagaaacagcgtttctcagactttggcagtagtcaccagacacatggtgctctttggatccttaggagtcaaagatggcaaaaacagcagaaaatatcaacttatcctgctgaccttcaaattgttgtaagagtaaatagtacacttggcaatttagtcaagttaagatacactgagcgccaacaatgtgctagaaacttggtgttcattggcaactataaaatccgtagccctattagatacttgaaataaaatacgatgtttttcaaacgatggatttatgtttaatctaaaagagatctcaccaactacccagtcaacacatatttttaaataataaactttaagcatcatgctaaaactactactactaattcgtatacatgaaacagttttctttgttccatcaaaggaagatggcttctacacctgggcctctatccagctgactgtctctcttccttttaaatttcttgttaaatagaaaattaaaggtcacaaggatctgcattgacatgaaagaccagtcatggttctgagtgtctgttttaaagattacctctgttattatacatagattcttcactggaagctagttttaagtttttaaataattatgactatagcacgtttacatattcatcatctggagaatttgctcctctgcacaggatacagcaacaggtagactttaaatctacactgcatttgctttgaatgattcaaccatttcttctgacttaaaaacatatccaaggataagtcatgcatttggccatataataagtgaagagactataataaatggctagtctgtgtgcttgagttacagtgcccattctgaggattcctgtgtctttcctcaacataactggaatctataattggctgtaatgtgctacaagaattatttcttatttcctaaaaaaaaccctgtgagtagaattttatcattatccagcattcttcttcttctcctcctcctcctcctcctcctcctcctcctccttcttcttcttcttcttcttcttcttctccttctcctcctcctcctcctcctcctccttctctctctctatatatatgtctgtctgtgtgtattctctttgtataataagtaaattgatttgagaagttaagagtccttaccaaaattcattaattactagaaatcccatcttcctccctctgaataaacttatgtgtgggcagggattcagataaactttattgtaaatagaaattttaacttgctgagcatgtaacagtgatctgttagatctctacagatattttgctctctgtcaagaatcacaatatcaggtaccattcagataaaacctaatcttcagtgatatcatttttcagtgtcaagtagaacaaaacgctctcaagcagcctttctacaacaatggcatttgctagtaagatactgcatatagctggttctacgtcttgccagccatatcatgtttttcacaatgaccactgttttcattgacgtgtgaagtactgacttcttattctacgtttaaaagattacttagttgatggaactaaatactatttttcttgttctaagaaaaaggagtctgaacaggtgagagggtgcgccacagaaccggatagcttctgggacaggcggaggcacagagccactgaggcagcatcctttgcgggcagcagacagccggccaccgtctggacaagaggacaggtgtccgcctggctcagaaggcagcctcagcctaaggagcagctgtcgccatcttggttccgggactccgcagaacctaggaaattagtctgaacaggtgagagggtgcgccacaaaaccggacagcttctgggacaggtggaggcacagagccactgaggcagcaccctttgcaggccgcagacagccggccaccgtccggaccagaggacaggtgtccgcctggctcggaaggcggcctcagcctcaggagcagtggtcgccatcttggttccaggactctgcagaacttaggaaattagtctgcacaggtgagagtctgcaccacagaagctgacagcttctgggacctgccaaagcaacacagcttctgagaaaggtcctgttttgggccttcttcttcggccaggaggaggtccaaacacaagatatctgcgcaccttccctgtaagagagcttgccagcagagagtgctctgagcactaaaactcagaggagagaatctgtctcccaggtctgctcatagacagtaacagaatcaccagaagaacaatctctaaacagagtcaactataactactaactccagagattaccagatggcgaaaggtaaacgtaggaatcttactaacaggacccaagaccactcaccatcatcagaacccagcactcccacttcgcccagtccagggcaccccaacacacccgaaaacctagacccagatttaaaagcatatctcatgatgatggtagaggacatcaagaaggactttaataactcacttaaagaaatacaggagaacactgctaaagagttacaagtccttaaagaaaaacaggaaaacacaatcaaacaggtagaagtctttacagaaaaagaggaaaaaacatacaaacaggtgatggaaatgaacaaaaccatactagacctaaaaagggaagtagacacaataaagaaactcaaagtgaggcaacactggagatagaaaccctaggaaagaaatctggaaccatagatttgagcatcagcaacagaatacaagagatggaagagagaatctcaggtgcagaagattccatagagaacatcggcacaacaatcaaagaaaatggtaaatgcaaaaagatcctaactcaaaatacccaggaaatccaggacacaatgagaagaccaaacctacggataataggagtggatgagaatgaagattttcaactcaaaggaccagcaaacatcttcaacaaaattattgaagaaaacttcccaaacctaaagaaagagatgcccatgaacatacaagaagcctacagaactccaaacagactggaccagagaagaaattcctcctgacacataataatcagaacatcaaattcactaaataaagatagaatactaaaagcagtaagggaaaaaagtcaagtaacatatataaaggcaagcctatcagaattacaccagatttttcaccagagactatgaaagccagaagagcctggacagatgttatacagacactaagaaaacacaaattccagcccaggctactatacccagccaaactctcaattaccatagatggagaaaccaaagtattccacgacaaaaccaaattcacacattatctctccacgaatccagcccttcaaaggataataacaggaaaaaaaaaaaaaaccaatacaagaacgggaacaatgccctagaaaaaacaagacgataatccctcaacaaacctaaaagaagacagccacaagaacagaatgccaactttaacaacaaaaataacaggaagcaacaattacttttccttaatatctcttaatatcaatggtctcaactctccaataaaaagacacagactaaaaaactggctacacaaacaagacccaacattttgctgcttacaggaaactcatctcagagaaaaagatagacactacctcagaatgaaaggctggaaaacaattttccaagcaaatggtatgaagaaacaagctggagtagccatcctaatatctgataagattgacttctaacccaaagtcaacaaaaaagacaaggaggggcacttcattctcatcaaaggtaaaatcctccaagaggaaatctcaattctgaatatctatgctccaaatacaagggcagccacattcattaaagaaactttagtaaagctcaaagcacacattgcacctcacacaataatagtgggagacttcaacacaccactttcaccaatggacagatcatggaaacagaaactaaacagggacacaagtgaaactaacagaagtgatgaaacaaatggatctgacagatatctacagaacattttatcctaaaacaaaaggatataccttcttctcagtacctcatggtaccttctccaaaattgaccacataataggtcacaaaacaggcctcaacagatgcaaacatattgaaattgtcccatgtatcctatcagatcaccatgcactaaggctgatcttcaataacaaaataaataatagaaagccaacattcacgtggaaactgaacaacacacttctcaatgataccttggtcaaggaaggaataaagaaagaaattagggacttcttagagttcaatgaaaatgaagccacttcatacccaaacttatgggacacaatgaaagcattcctaagaggaaaactcatagctctgagtgcctccaaaaagaaactagagagagcatacattagcagcttgacaacacacctaaaagctctagaacaaaaggaagcacattcacccaagaggagtagaaggcaggaaataatcaaactcaggggcgaaatcaaccaagtggaaacaagaagaactattcagagaatcaaccaatcgaggagctggttctttgagaaactcaacaagatagacaaacccttagccagactcactagagggtacagggaaagcattctaattaacaaaatcagaaatgaaaagggagacataacaacagatcctgaagaaatccaaaacaccatcagatccttctacaaaaggctatactcaacaaaactggagaacctggatgaaatggagaagtttctagacagataccaggtaccaaagttgaatcaagatcaggttaatgatctaaacagcccgatatcccccaaagaaatagaagcagtcattaatagtctcccaaccaaaaaaagcccaggaccagatgggtttagtgcagagttctatcagaccttcaaagaagatctaatcccagttcttcacaaactattccacaaaatagaaacagaaggtactctacccaactcattctatgaagccgcaattactctgatacctaaaccacaaaaagatcccacaaagatagagaacttcagaccaatatcccttatgaatattgatgcaaaaatcctcaataaagttcttgctaatcgaatccaagaacacatcaaaacaatcatccatcctgaccaagtaggtttcatcccagggatggagggatggttcaatatacagaaatccatcaacgtaatccagtatataaacaaactcaaagacaaaaaccacatgatcatctcgttagatgccgagaaagcatttgacaaaatccaacacccattcatgataaaagtcttggaaagatcaggaattcaaggcccatacctaaacatgataaaagcaatctacagcaatcccactaaaatcagggactagacaaggctgtctactctctccctacctattcaacattgtacttgaagtcctagccagagcaattagacaacaaaaggagatcaaggggatacaaattggaaaggaagaagtcaaaatatcactttttgcagatgatatgatagtatttataagtgaccctaaaaattccaccagagaactcctaagcctgataaacagcttcagtgaagtagctggatataaaattaactcaaacaagtcaatggcctttctctacacaaaggacaaactggctgagaaagaaattagggaaacaacacccttctcaatagccacaaataatataaaatacctaggcgtgactctaactaaggaagtgaaagatctctatgacaagaacttcaagtctctgaagaaagaaattaaagaagatctcagaagatggaaagatctcccatgctcatgcatcggcaggatcaatatagtaaaaatggctatcttgccaaaagcaatctacagattcaatgcaatccccatcaaaattccaactcaattcttcaacgaattaaaaagggcaatcggcagatccatctggaataacaaaaaacctaggatagcaaaaactcttctcaaggataaaagaacctctggtggaatcaccatgcctgacctaaagctttattacagcgcaattgtgatcaaaactgcatggtactggtatagagacagacaagtagaccaatggaacagaattgaagacccagagatgaacccacacacctatggtcacttgatctttgacaagggagctaaaaccatccagtggaaaaaagacagtattttcaacaaatggtgctggcacaactggctgttatcatgtagaagatttcgaattgatccagtactatctccttgtactaaggtcaaatctaagtggattaaggatctccacataaaaccagagacactgaaacttatagaggagaaagtagggaaaagcctcgaagatatgggtacaggggaaaaaatcctgaatagaacagcaatggcttgtgctgtaagatcgagaatcgataaatgggacctcataaaattgcaaagcttctgcaaggcaaaagacaccgtcaataagacaaaaagaccaccaacagattgggaaaggatctttacctatcccaaatcggacaggggttctaatatccaatatatataaagaactcaagaaggtagactccataaaatcaaataaccccattaaaaaatggggctcagaactgaacaaagatttctcacccgaggaataccgaatggcagagaagcacctgaaaaaatgttcaacatctttaatcatcagggaaatacaaatcaaaacaaccctgagattccacctcacaccagtcagaatggctaagatgaaaaattcaggtgacagcagatgctggcaaggatgtggagaaagaggaacactcctccattgttggtgggattgcaggcttgtacaaccactctggaaatcagtctggcggttcctcagaaaattggacatagtaataccggaagatccagcaatacctcttctgggcatatatccagaagatgccccaaccgataagaaggacacatgctccactatgttcatagcagccttatttataatagccagaagctggaaagaacccagatgcccctcaacagaggaatggatacaaaaaatgtggtacatttacacaatggagtactactcagctattaaaaagaatgaatttatgaaattcctagccaaatagatggacctggagggaatcatcttgagtgaggtaacccaatcacaaaggaactctcacaatatgtactcactgataagtggatattagcccagaaacttaggatacccaagatataagatataatttgctaaaaacattaaactcaagagaatgaagaccaaagtgtggacactttgccttcttagaataggaaacaaaacacccatggaaggagttacagagacaaagtttggaagtgtgatgaaaggatggaccatctagtgattgccatatccagagatccatcccatgatcagcttccaaatgctgacaccattgcatacactagcaagattttgctgaaaggacccagatatagctgtctcttgtgagactatgccatggcctagcaaacacagaagtggatgctcacagtcagctattgaatggaccacagggcccccaatggaggaactagagaaagcacccaaggaactaaagggaattgcaaccctataggtggaacaacaatatgaactaagcagtaccccggagctcttgtctctagctgcatatgtatcaaaagatggcctagtcggccatcactgcaaagagaggcccattggacttgcaaactttatatgccccagtacaggggaatgccagggccaaaaagggggagtgggtgggtaggggagtgggggggtatggggacttttggtatagcattggaaatgtaaatgagctaaatacctaataaaaaatggaaaaaaagaaaaaggcttatctgagaaatgcctggaatgaaaattgcaagaacccaaaaggcactatgttatcttttgacacattttcaaaatatcattttatgtagaaggcaaatagatatgcacttcaaaaaattcatttagactgtatttacattcatatttcacatgttgacttttttaggctacctacataaaattttcactcttccaaagtctttgtaaagaatatatgcagactgacagtttttccttgttatttttatattggcatcttaattcataaagatagtctgaggcttacattatttctattcaaactttattcttttgagttgtcgaaatatttctttctagtgaggatataatgggacagtaagacaaaaaaataaaaagacaacaaacactggtgtgtacaaactcaaccacctttactggaattttggttacataaaggcctaatctccttatttttaaatgcaattctgtcttctgacttatattttaccttcagtttaactgacctgaggtcagatagccatatacaatatctgctatcttgattttctaagctttactttgagttccgatatactgttcctttttgtaaacatctatggatacttgtggataatactaacattaaaaatactagtaatgggctacagatggttcagcggttaagagctctgacttctcttccagatgtcctgagttcaattccccgcatccacatggcagctctcaaccatctaaaactccagttccagaggttctgacgccctcatctgatcttgtgggaagaagatatgtaagtagtacacagatagacataaaagcaaatactcatgtgtgtgcatgtgtgtttgtgtgtgtttgcaagtcttattatatgaaataaaataaaggagtctcaatgtcgtcatttaatttgttacattttaatcatgagataaaacattgcttcagaactctaaaagcaaaggtatgcttattattatttatctcattgttaaaacaaaaagtaagtgcagttctttggttaagttatcactgctactcaaatagggaggaagctcaatagctctgagggaggggctcacctcaactttgcacacagacatgtttcatacaatattctaaagatcctaggtaacaatgcaacccagtgttgtcaaacaagtattttattattttaaaacttaatgaagtagactagttcctttttattcttaagttggtattaatttttgctttttaaagtatgtttcttagtgttttgaaattaataaaatatgttaaatccattttagcatttaatatgctattaatcaatcttcaatttattaattccctaatggactagttaattagaggctgggtatatttttccatataaaccgtctgatctgtgcaatccatatgtacttggcaggttatttatgaggtgagatgatcagttactaactgcgaccctgatggtaagagcattttcccttcaccgtggattcatgctcccttttttttccttttttttttttttttgcttttaaagatgttctctggtagagaaaatgaccttgaaaatgaaacaaaacaaaacagcaacagaacaagccacagcttggggtttctttggaaggaaccagtcaggtgtctctttcttctcagctttaactttaaacgtgagatgtctttattttgtgacctagtttattacagggatattattaatgtatattaatgaaagtttactttttatttttaagatttattattatatctaagtacactgtagctgtcttcagacacaccagaagagggcgtcagatctcattacggatggctgtgagccaccatgtggttgctggggtttgaactcaggacctttggaagagcagtcagtgctcttaccccctgagcccgaaagtttactttttaataagtgataaaaataattgggattttgtaactgatgggtcatatagtgcactgtcatatgtacagagagagagatgcaacaaagactagcacggaaggaacttatctataaatgaagcccatactcatctatgaacaaagcatgacgtgtttttaaccttagcctttcgctgacttgatacttttatacaaaaatatataaatgagattcctgatgctctgtttatcagttattattgtctcaaagggttaaaatacttggcaaagcagtttaaatggaagaacgttttcttttggctcatagtttctgagcaggcagtgcatgatggtggggagagagcatgttggtttagagcagtgcatgtcatggtgagcaagaaaaccaagaaagggaaagcagcctctgctggtagtcatcattgtcgtcatcttcgtcttcttcctcctcttcctcttctttctccccctcttcctcctccccctcctcctcttcctcctcttcctcctcttccttttcctcctcctcctccacctccttctcctcctcctactcctgctcctcctcctcctcttccttcttcttcttcttcttcttcttcttcttcttcttcttcttcttcttcttcttcttcttcttcttcttcttcttcttcttcttcttctccttcttcatttcttcttccccctctccttttattattcagtctgtgctcccagtccctgggtgggtgtcatttccatttaaacatagttttcttcttagttaaccctttatataaactccctaatagatgtactttggggtgcaccttacagttttctaggtggttctacatttagccaagtagacaatgcagattagccatcatactccatagcattaaatatatgaatgttaatatgttgttgtgtatattctgccttaggagatatttctaatgtatgcattaaaatcaaaatgatcactattaatgactctcaacaaagcaacactgtcatatcaaagaaaaagacactattgagacagtagttcttataaagcagcagggaagctcaaacaccagcccttagtgccccatatcatcagtttccctaatgtcggtctctactaccctaacttctcaatataaagacaggtggtattctccatacaccctgtttgggtactagcacaataggcaaattgcattgacacaatctattctaatatactaaaatttaaaaaaaatggggtaacatattggcttttaaactctaactgggcgatggcttgtaatttagaaacattacatctctaatgtttatactattgtaatatccatgatttttaaatcagcagatttctgagctacaagagcatgggaaaagaatggctatgggctctaggggttctgtggacaatcagtgatgaagatgtcagtgctctttctattcctgattaatgcaaacagaagctgtacaaatgcgaatcatgttaattttcagtggaaagataattttatggatactttttacaatacaattgcttatcagtaatattcagtacataataagtagctgctactattattcagccaatattaaatgtacgcctatagattcaaggacttaagatgaggagattcaaactagaacgaattttggaaatttatcttgtcagaaatttagaatgatgtgtttaaataagatgttttgttgatatttttacttttagatgtgatcttatatgtttcaggcttccctgaagctcactatctagctgagacgttgagttcctgatctttctgactttacctgcccaatgatgggcttttagtcattaggtaccatgctcaacaaacatttatttcacagttgacatctaccatttatttcctagaaaacaccaggtactaagtaaacattttaaataagacaatgttcacatagtagtccttaagacattcagtaagttaaaaaaaaaagtccatcttcctcccacactaaatccatctcattggagttagtagtttccccactgtctcacttctgtgttattttgctttctcttctttcacgagaagaccccaaaatatctcaatgcagccactgctagttttaatatcagttcctacttctaaaagtgggaattccaatatgacaccaaagtttttataaaagcttgaatcatcattaaatagacatattcaacaacctaatatcatgtcatgtgtctatgctttctgctctaggaactaccaaccaaaacacaccattgtttcccttgcttatggttgatataccagtcgatttttaataggaatagagtatctttgaatagagtgtctttaaagtatttagattactcaagctctaaatatgctttgttatctttgagacttccatgcaatagcattatatcacagaaatcccactgtaagatgaaaatgtagttagagaaaaaaaaaccattcaggacacacaaaccactgaacaccatagctagcaatatacacaggaatgtgttggttgttcagaaatagtaacggtaagttagcccaagttagagacagtcctaatatccacaaatgttttagctttaatattttcaagtaggacctcatggactgaattacattcccctacccattcttctatcctaaattcaattgctgaaactgagagtctctaaatatctgaaggtctggcttgataatgagctctacttatctaatgactccaagattctcatccaatagagtaattcccttacaagttgaggaagagacaagagatccatttctgttcagtgcacctatcagtcaggccttgtaaagacatagtgagaaggtggacatctacaaccttagcaaatagtcctccccagacactgaccctgcagtaccatggtcttgaaatgtctgctttccagattgtgaataaatttttttttttgtgtgtgtgtaagccatctatttcttagcaccatgctattttatgacattatgtaattttaatgtgacaattggtagggagcactttttttctgaagttcactcagttatttaaactgagatgacacacacaaaaatattaaaacttaaagacaaaggcttcaggttcaaagtggggttccacccctcacaggttacatgctcttagccagccaaagctggttgtttttttcttttgttttgttttgttttgttttttcacttgaaactttacagtaatatgttcctttctgttcattacaaggattaagtaactaatgatgctagtttttaattcattatttgtacccatttaacaaacagattttaagaatgagaaaactcatacaacagtatattacattttgctttggcattcatctccctgagaaaagatttttggaatctcaataaaataatatttgatattatatcaaaaaggttctatagaatcattaatacagaaagtataatccatacatatatttatacatatacatctccccaatttacagcatcttacctctttgctttcttctagatctgattcactgctaaagtcttctgtgtttaagttctcaaagtcagactctcccacagcaatgggcacagtcacagtgaggctggggttgtttatgaatgacatataatcactctcatcaatgatgtacttctccacactgctgcccgtccctatgccacttgtggttccattcacatctttcagacagtccagatctttcccaatttctgttgtgtggttagagatacaattgtcttttctgttgtttagatcatcaagtggcttaatttcatctagaatcttctgtttcttaacaaaggattgttgaatgaattcatatatttttctttttacataagctattcctttgtgcatcctgtccacagcaatctgcaggttgttcatctcattgtcatcatcagtggctgcaaggttgtctgcactaaatgagctcagaagcaaggccagaaagaggttcaagaccttgaaaacagacataagtatgtgttcaccacaacacagaggacataggatggcttattcctttagctatagaatgaataaccgaatgctatatgagcaagatacagcacaggcattgctagaagttaagtgggccaagaccagaaaacatgaggccctgggttcaacactccgccctagaaaagttttgagcactctgaatttgtgatattgctccatctctatgtacatgaggcattctttctactgctctcaagatctcccatacatgaaatgaagaacttgaatgaattagtttatcattatatttaatattatatgagtaaaagaagatatatttactgagatactttaacaattccaaatttaaaaatgattaatatttgcaattatttatttaaatgtattttgggttttctctcttcatgattttgtgttgttggatgataactgaaaaaaatcatagtcatgaccaaatttagaatgaaagtcttcaacatatgcatggaccattcttgttagcactattctatagcaaaaattgccccctttctccctcacatgcacacgcacacatagacatcacacacaaacacacgcacataacatatttgtgtaaatttttaacagtcctatgcaatttaataactaaatgcaatgaagtgactgaataaaatagagttgagaagccaggtggcacaatcactttaatccaagtacttgggatggagaggcaggtggatctctgagttcaagcccagctagatctacagagcaagttccaggacagccagggatacagaaagaaaccttgtcttaaaaaaatagagctgtaaaatatggatttgagagtaaaatatcataggtaatattaatgtgcatacatttgttttaagatgtatttctatattaccatagtagattgtgatactatactttgccatgttgcggtatatttttagaataagaagataaacatatcttaagatcagaggcatttaaaattatttatcatgaaagtcattttttaataaattgggcacaaatttgttatgttattgatgtatttctgaaatgcatatctaacttgggtacataccacaaggttcccaatcaccatgaccatcatgaagacagtaaggcacatagcttgtcctgccacctccatgcagtcccacatggtctctatccactccccacacagcacgcggaacacgatcaggaacgagtggaagaagtcgttcatgtgccaacgtgggagtttgcagtcagtggcaattttgcagacacaatctttgtaactttttccaaacagctgcatgccaaccacggcaaaaataaagacaatgatggccaacaccagagtcaggttgcccagtgctcccaccgagttaccaatgatcttaatgagcatattcagtgtgggccaagactttgccaacttgaacactcggagctagaaaatgagaacaaattaatatacattattatgatcttcacaagcattaattatcttgagacttactaaagaataaggggctgcagctcagagacagaacacctccttagtgggcatgcagccatgagatccgttgctagcactacacacccctaaaaaattctgcttacattatcttgctctaactttctcaggttcatagttaatatttagaccctcataggaagaatctagcttttccagattttaataatgtggctcatcttctctgaaagtgatttcctagttgcatattagaaactatattctttaatttgtttctctgagaccatcttccaagttttatagtgtcatattgatatctgaatgtgaataatttctgccaaaggattcatttgtcaaaaaggttctaagtaacattgcattgagagcattgatgaaaataaaatgaaaaatatttattatctattaatattataacagaggaaaaatataaataaatgcaatgtattgttaaacctggattatttgctatgactcttcctcaatcttcagggaatttgtatgaatctatctatctatctatctatctatctatctatctatctatctatccttaatagacctgcaaacttttgtttttatggaacatattttttagaagtagaattacatgcatacattttatgtgaatatcgaagagttatttacattttcaacatttattaagttattaaccatttctattaaacacacttcttcaggttgaaagtattaattgtccaagtcattagaaagaacacattatcaacacagcaatagaaaaagatatcagtgttcacgtgacggggctagtgacagctcaaggctctgggttatgtaacccagcactgcaaacttataaatgataatattagaaagtttacataaataggcttttcagaagaaagttgcctttgtaaaaaaatatacaaatattacctgagagatattattccccatttagaggtatcagcctacacaaaaacttaaaatgataatagttttgtggaaaagtatagggaagcactatgagagaacaccactggggaaaacagttattattgcagttgtcttgtttaccagtcgaaatgaacggagaactgacaatccttccacattggcaaggccaagttctaccaggctgagtgtcacaatgaaaccatcaaagatattccagccttcttggaagtaatagtaaggatccattgcgatgattttcaggaacatttctgctgtgaaaatcccagtgaagacctaaaagcaaaaccatattatttaaattatcttagatagtgataacatcaaagataatattatatatatatatgtatatacatatatatatatatatatatatatatatatatatatatatatatatatatataaaagactaatgctacttctacttttccattattgatcctaagattatcctacaagtttatttgacaatgctggtttatattagtttactgttttatgctcatagaagctccaataaccagatagtgtaaatgctgtaactattttattacagatgaagagaacaatatttcaaggtatataaaatgcccatctattattaaccaacttccagacctcatgtcacctagacaagattttgccccaaaacattttatttgtaagtttatctttattcccttcaaatcatgtgtatcttatattattctcatcactatcattaatattagtcacatgcactaaaagtgcgtttccagaatctaaatagtagagatttaaaaatataaatccactatagcatatgcatatttacattgtctttatcagcaagatactaaacattctcctagatattatatagaatgcatgttatactttagatagttctttcttcaaataaaaacctgagacttttaagttgagtctgctggaaaatattttaacaatttatgcttcaaagtaaaaaatggagaatattgtcgaaactttcactaaaaatgggcttactaatcatatgatgtacaaaatgcactaggtactgtcaatatttcatgatatgaatctagaacagaacttagactcccttgaccctggaaggaaaaaagatggagacacttttgtgttatcattctttgaaagagcatataaggaagagaactcatgaccttatttgaaccatctggagctaggacagagtgatcttatcatttaaagaagaacatggccttagattctgaaagaacaccattactgactttttaaattattattacaggtctatgttctatttctcagtttttgcacagacattaaaggccattatttggcaaaaggtagtgtgtacccgtctggatattattgccttagggatgcaggaattgtggttgaaagaggtctaataaactattgaagataataaacagtttcttaagcagaaaatttgaagaccaagctcatttatttaccttcttgcacacttaccaagtttcccactgtaagaacatggttgaaatgttcagtcatggggtagtgctccatagccatgaagagcgtatttaacacaatgcagatggtaatggccagatcaacaaatgggtccatcaccaccaggttgacaatatgtttaactttcagccaatatggagaacagtcccaaattaagaatatgttggaaaatttataccaacagggtggacatttctgcctggattcttctagttctagatttaaaaaaaaaatagaagaaacaataaccaattatttgaaccatctagagctaggacacagtgattctatcatttaaagaagatcatggccttagattctgaaagaacaccattactgacttacaaatttacaaatttattttagatccactaaacatgctctcagtagcaaacatatttctctttgctgcaaagataattacttgataaaatggtacagtatcattagtcatgtacatagagataggaaagaaaactttttgttttgtttttgcatagacagtgttgcttaacacttggcctctattacagtggttgggcatatagacaaaggttccatggaaacatagcctggaactattcactctgtgtaaaatttcttgttactgataggctacacaattttaagatttaggacaaggattaatgtaatatataaagaaatcattctttatgctttgattttgtgaaagtgacttattcttttctccagtcttaaaattatttcagatcataatgtaaggggccatgctgctgaagtttgaagcacattacaacaaaggatttgtgactaatggattagaaacctctagctgttcccacatacttattaagacattaaaagttcagaagtttagaacattgaatttagtatgtaatactttcagaatacatcaccagccatttgctagtaggactgttccttttacttttgttcatagagtgtacttgccaacacataagtagagagagttgactccaacaagatattgcaagatggctgaactgagggaggtagggtttgttaccaaccttctactgtatttgttaagatgctggctatgctcattgccctttgcctctgggaaggatcttctagaaagtccatggaaacatggaaagagctcgacctcctctttctcatctcagtttcagtggttgttccctgcaaagcaaatgctaaggcattacatgactagcttgagcaatacagcacagaaataaatggagacagtgattttcatgaaagacatgcgtcatgcgtcttcatctttgatggccaatggcagatactggtgacttattggatcattaacctggaatattcaaacagttaaccatgtagtcataaaggaaaatataaaattttgacccctccttgattttatactcttatgaaataggatgcgatcaaaatatagttagtaaagctttgcataggcatttatagcttgttttcaattaatgaacatactgtcaaatcttaatgccttaaaatcttatatatggtcaggccatttttcactttcgagaaagtagctgtttaattttaagaaaataccgaagaccataacacacttagctgtcatctcaatttctaagcataagacatatactcatttattataaagtatatgctgatccatgcatgtgatgcaggggcaacagtttcatccaggataccaaagcaataagtcatctgatttacaccgagtcatgcctcgtcatgctgatatatttccaattattttatctggattaataatttattggtgtctctgtgtagattgttttgtgaatacctatatcagcatttctttcttagtgagataaatatgatccttagaaaatgtaggtaatgatgaagctatctaagcacagtgtttttgaaaatctgaactaaagcccagataaactgtaagagtttagtgggaagatttactatacaccctttacactaaaaagtcattcatttaatcttacaataatagggcactaggggtgatgtcttcatatgtaaattcggtatgggtacatagcaaatcatccaaggaagtaattattgttcaattaatccttagcatatacagtaggtaatgcattcaggtttgtgcaaggagtgccgaggcgctaacatttagctggttagtctattaaaggtgctacaagatgcaggtgcattctcagctcgaccaaccaggaatcattctcaagagttccattctgtagaaacactggctggtgcagcaatcataggccagccatgcctgaactatgtaaaactttcttacattgtcatcagtagctggcttatctattatcacctctggcagaagctgtccaactggcgatgtgggaactgagggtccaccaaccaaggaaaccacaccattgcaatccaccgtgctgtgcatcttcccattggctggaaacaccgccagcattcgggaggacctgctggtctggctcaggttactgttgcgtcgctctccgtgtcttcggggaacgaacagtgagtctctacggctctcattatcctcaaaggtgctgtgttcatcatcagcaaagtcattctcagaccccacatccttggctcgccctctaaagctgaaaagacttgttctgctattgcgtcttggggagaacagggaaccacgaatgcttaacagagactgaaagtttgaaacacatgacaaaaagtaaaattacattagaactgcctgttgaaatagttttgcaagtttaagttgaagaatattgcattgttattttagagagggtagcacattccttctgattaatataatttattggcattcagatgagattaaattagttctatacagtatggcttccagccattgatattaaataacagatagctggagtgcagcctaaaagtaatgggagaaaaaaaaatacccagccaccacgtctcaaatttaaacagagacatccttaaaaatctctctatgtatgtatccacctacaatgaacatgggcagcaagacagcaacggtttttaatttctctctccttttggataattccaacaatagttttcacagactattttagttcagtttcctaaaaccatgttatttatttttttgacacagctgtaaaacagattacttgtagaaccagaaagtaaaaatttcgaaattctgaatgatgcacttttctataaagtttatcatggctaatatttttaaagttcatgggataattgataaagaagttatgggatgacaaccaacatggtgccttaaattaaccaaaggtacatttctgagtagctaacccctagtctacattttgttgatgtggttagaatagctgcaagattaaatgtcattacaattaccagaaggcacatttaacatgaaaagccagttctcctgtcttccaatcctgtgttatttcaaaagcacctaagagtggatttgcatatatgtggatgggaagtaaaactttcacataactacatagaggggaaaaaacagttttaagtgtaatgcaacagtagtcaattcggttgatgaaaacccatccatctatttaaattctctctcagatggctcactctcatcggtgtatccaagaactctgcagtgcgtacctgatgcggggaagagtacctcttttcatatgtcagtctattcccttctatggagaagcgaaaccccttcctcctgatgctgtcttcagactcagacttgtggaattcatcatcatctttctcttctcctccagactgctctttctgtttcctttttttcctccgatttcgtctttctttagcactcttcgaactcaacttagaggcttctgaagagctatctgagagcctgcctgctgcactgggctccctggaatgttctgaggctgttgtagccgctgcctgctatatagaggagaaaccaattcagtgtgttgcaagaaacgactgcattaaatctttaagatgctcaagtttggtgtgtcatgtccaaaatgcaagctaactgaaaccaacatctagatgatgttttccaggtatgaagggaagtttttttttctttttaactaataatgaattttaaaaataatctacttttctccatggtaacatttattaactttgtctgatgccgcagagattcgtaagattcattggcagtcaagaataactcaagattctattcaaagctggtaatgaggtagtgagcaggggtcctctcaggtttccatgcttatcaaagtgttcaatatcttccacatagtatcaacatatgtggagatgttccacataatcagcgttatgaaacatatcacagtttcttcctcactctcccctgatacagttatctatagaaaggagagagttgagagctttctgctaagcaagttaaaagatgttcagttctctaaaagccatcccaactatcttcatatcaatgttggctcttactagttatggggtaagatgctgtgtggtcacagcttgttctgttatgaagaagttagaacttcttagtcaacattcttcccacaattcccttaatctagaactgtagcagataaattagcatgcttgaagtaactcttttttttttttatggtcaagatggttacaaataaatttgatttaaatagtttaattagtctttttgaaaatacacataatgaattcgtatgtcccatttagaaaccacaaggaaacgtgggcaattggattcatttttttttttttcattcagtgagtcaggtacactgacaagccatggaaaggtcaagtaaacctcttgtagtactccatattgctaatgatgcttctttgcctagtggatggttttgaccaagagaacattttattaaaaggaaattgaacaaccccacctaaagacattgtatttctgaataaagaaaataataaattactttaatgaaatggccaaatgggttttatatgtcaactaatgaatttgcttgtcagaaaagattgttgtcttatgatactttttctaatgctagtatatttgagtaaaagattttaaacttgggggggggcaaaaaagcccaaagttactatttctcttttcttcttgattctatttaaagtgataaaaataacataagaagcatcttctgtagctagtgtaaaacagctctgtacaacttagtgatgtgactaggccaattcaaactaaaaagatgacccatacatagaagtccttggagtttgatgtgctcagctttctcacatcctgtcagatgactctgccttttgtttcattacagctctttgtaacatggcagtgaaagaggtgacaccagaagactagagaaatgaaggtcggagataagacctacttgaactgctgagtacctgtgcagcctcttgctgcttcttaagttgctccaacatctgctgaaattctgcctctttctgttcagcctcctccagtgtggcctgattctgctcctcataggccatggccaccacagccaggatcaagtttatcaggtagaatgagcccaagaaaatgaccagcacaaaaaatatcatgtaggttttgccagcagcacgcaatgtctagaaacaagaatatgagaattatttttacaattatgtcggtattgggtgacttcacattttaacttacttgtgtatgtggcagaactctgacaaaattaacattgtgtcccatcagtatttctttaacctctatctcttctttcttctttaagataagcattcatagtcataataagggattcttggattcaccaggaataacagttgatagaaagcaatggggaccaccatgaaaaagctgagcctttcatggaaattaaagagaccaatggaaaaggtaatacttgagcagaggacagggcagagggaagacttggcttttgcttaggagaaattgtatctaagaggaatgagaaatagaattcaaggcatggagaaacagaacagaattactctccttggcgttactccatttaatgcgtattgtaatcaatgggttagaggagtccgagtcattctttctctactgtatcatgctgcgggttgtgtttcatgactcagtttgtgttcttacacgcttttacttaaattttcagattctcaccagttggtatagattttcccagaagtcctgagtcatcagtcgaaacagggacaaaaatgcccaactgaaggtatcaaagcttgtgtaaccataattagggtttctaccagcttttacacacatatatccttctggacattggctgcaaatggggaaaaagaaagtatgacaagacattctgctgtcttcttactctggtagaagcctacacttacaaaataatctagtcactacttaaaggacacaggcgtgtggaatccgaattgctgatacatttcccacctttgactccatagtatctatcttattagctgcaaggtattgatattgcttagtaaccttttcccctcactgtgaagtctccaaaggtgattcatagctttatacgtacaccaagaaaatagcattacagatcaaagtgttgcttcttgctttacagatgaaactttaatatttagataatttcttgttttatttatatcatagttactgacaattagtatgcataaagttagttgctgttatcagtcaatttctagagccaaagatacacacagacacatccatatacaaacatatgtatggggacatactacacatacatctcacacgcgtgatcagcttaccctgcatcagagctatttccacacagcagtgcatctaaaacaccctccaggaaataatgatatcctgtttgaaaaaaagagaaagccacatgatacacacttgcattgtgaaacacattaaaagaagagtaggaaagtcaggtcttactttttggttcactaagtgagtttacaagtatcttatcatccacttaaacacatgagttttttccttttcttccttcaaattctgttattaaattaaaggtatcgataatcaactgtacgaggtttttttcttttcattattagtggaatgttagtgacaaccatgggtacttagggaacatttatgaaaaggtatcagtattttctactacttttgtaaaataaagaaaaagttcatcatccaaagaagatgacaatgatgggtatctcaaaaataactacatatttcaaaagaaaaaaatgatatattttcttgttctattttcatattttcaatccctgttaaaactttcaaattaattataacttacatttttcagttcgtagtatatatgtcaattgacacaaattgtatcaactatctgaatattttaatgaaatgaaatattttagaattgaatataaaacaaataatatttcttacaaattaatgaaaaatgtagaacatcttaaatattaaagttaaaacaattagagtaggcgaacatcaaatcttatcagttctccctagttctcaagagttcacatctttcattactagaggagccatgtctgcaagactttccttggccatccatttcctttccatcaaagattgacaaggaagaaacaacctcaggttgtgtccagtaggttgtatgctcacacagtatcctcagaaaaaccattatcccattgcaactactcattcaaaaagtattagcgccgggcgtggtggcgcacacctttaatcccagcactcgggaggcagaggcaggcggatttctgagttcgaggccagcctggtctacaaagtgagttccaggacagccagggctatacagagaaaccctgtctcgaaaaaccaaaaaaaaaaaaaaaaaaaaaaaaaaaaaaaaaaagaaaaaaaagtattagcagtattagaaataaagcgacgttcattatccccctataacttagttgggattttgtatcctttcaagaagtgaaatgagtagataggaacaacagaaaaaagagaatggaaacaggccacctcaggaggtaggaggtggggtgaccctctagaatgtaccagagaccaggaaggtgagagacgctcagggggagggaccttaggtgaaatgcccaaccgtgggtagaaggaacttgtagagcccacctccagtagaaagacaggacatcaagtggagggatggggttgccatcccaaagtcaaaaactctgacccagaattgttcctgtctaaaagaactgcaggaactaaaatggagaagagactgagggaaaggacgtccagtgccagcctaattagggatccagcccaaggggagactccaaggcctgatactattactgatgatatggtgtgcttatggacaggagcctagcatggctgcaatctgagagccccaacaagcagctgaaagagtcagatgcagatacacccaaccaatggacagaagccaggaactcctgcagttgaattagggaaaggctggaagaagctgaggaggatgaccaccccataggaagaccagcagtctcaactaacctggatccccgagacctctcagacactgagccaccaaccaggcagcatgtaccagctgatatgaggcccctgacacatatacagcagaagactgccaggtctgggttcagtcagagaagataaacttaacccttgagagacttgagatcccagggagtggggaggtttggtggggtggggtgtgggcggggtgtagggacatcctcttggaaatggggtaggagggaggaggtatgggatgaggactagtcagagggcagactggaagtgggataatgactgaaagattaaagtaaagaaagattaaagaataataaaagaaataaggtgtgtaaatattttcaaaatttacatcagataattttctaagtgactacaacatccttgtgatcatgtttagtctgtgactagacaggaagcaggcagactatgaaaggataagtacacatattgatggttcttacttgagtcttgaatgtatgatttccagtcaaactcgaacacggtttcatttacaagtgtgccattgtaatccatagttatattcttctctatgctatgttcctcaagggaagcgttggtgggaggccactgtacacatttattcctcaggttgcccatgaagagctgcaacccgatgagtgcgaacacactgagacagaacacagtgagtatcatgacgtcagacagcttcttcaccgactggatcagggcccccacgatggtcttcaggcctgagagaaagaagtgtatcaagcatctgaaatattaaataagtccttcacacaagtctctcggagacactaaataaacgtgtaagtcccaaaatgtggcccatggcagggacattgtcctataaaaagttcgagagtgtagcttcatttaagaacatagcattcatgctgttgtaggttattctttaagtcttataattggtcttttgttagcaaagaatgggattgtttttgcataggcatcaatgggtataatgaataaaaatgaaaaatttatacatataatagggaacaaattctttataacattgacattacaaaaatactttttttttctcgagacagggtttctctgtgtagccctggctgtcttgaaactcactctgtagaccaggctggcctcgaactcagaaatccgcctgcctctgcctcccaagtgctggaattaaaggtgtataccaccactgtccggcacaaaaatacattatatagtaaaagttggttgggttgaatatcagagtgtccacaaattaaacacaaaggttgataaaacctccagagagagtaatcttataggaagtactcagtcttatgattctcagctttctgtaatgatgaatggcaagcaaggaggctcagttgaaaaagtctcagagttaactcactgattaacctacatgctttcatatagctctcacctggaatgactgaaatagttttcaatgctcgaagaactctgaatgttctcaatgctgagacattgcccaggtccacaaactccgtcacatatctgtaatgaggagttcacacacagacacaataacaggaagcaaagaaagttttgtaggtacaattaccttatgctttatagtaattgcttctaattagaaatgtgggaatggtctttagactcaatcctctaaatgtgtgaatagctaaaaattacctaggtatacaaactttgttacttacctgtaaatgatttaagattgaaaagacactagcatttatctgatattttatgaagatctttgctgcttttaaatagtgtaagttgcaaattaaaatttagacttcatcaatgtagtcttatttttcatgataaataccacaactaaatgtaaatttcataaaatatacaatcttgatgccatttggtaggcaaggtagaaacactatatgtgaattgggaaaattaactaaattaattagttaactggaaccaaatccacaggctagggtttcagctagaaaagaaatgatataggaaatcatccaacagaactatcgattataaaagattgcctcttgccccactattcaagactcgcatttcctaaaataacgtttgaatagaagttgaacaaataaattaacaatagcatcttacatggcccaaggccactctgtcatcacttctattttagtctcaagagtgagaagtctcaaatactgtcctgaaagttgtggctgaaacgcatgggaacctttcatattccaatcagacataaagttatacagttaaggtcagacatccaggatttgcactttggagccgatcagtaccatctcctgtcctgtgtatcccttcactcctgctgatgcccagaaagtcagctacccagatgggataagtggtattaatccactgtcctccatacctacttttgactattcttgaatagctacctattattctcatctcttcctggtgtggaggggcgtgatttatcactagcaaaagggagaagacaggaaagtagggactgaatatacaactcagtgtatattgaaaagctttgtgttgagtaaaataaagaagagcctaaaaacaagagagggagggagggagggagggagagggagggagggagggagggagggagggagggagggagggagagagagagagagagagagcgagagagagagagagagagagagagagagagagagagagagagagagagagagagagagagaggaatacaaattgaatcagaagggaaatagaggcaaggtatgtctgctcaagaaataaccatttatttgatttatgatgtatcaaatgtctttttcaccttaggatcttatttccagcatggctacaatctttctactattctataaaggtaacaaaagaagccacggggtgaggcacaacaggactatcagtgaaaagttcagtgcaagtttgtgggaccagtgcaaattttgctgtgtgaactttcaaaaccatcctccagctcaggagataaataagttatgcttcagtattacaagtatttgtgtgaggagaccagaatatacaatattttctttctttttggggggtagggggtgagacaggatttctctctatagccctggctgtcctggaactcactctgtaaagcaggctgaccttgaacttagaaattcacctgcctctgtctcctgagtgctgggattaaaggtgttcgccacacctgcctggctacaaaattttctgatgttttaagtgttattaaaattgctattactattctcatggagcagtggaatgggtttacccttttgaggtaaatgttaagacacggagttcaggtgcccaaatcatgccaggatgttttaccactcgagcatgttgtttaaaaacctgagcatagacagcaaaccaaactgtattctctcaggtttccaaaagagaaggcacttacgcgaatgtaatgacagtgaagtccagccagttccatgggtcgcgaaggaaagtaaaatcttctaaacagaagccccttgcaataatttttattagtgattcaaaagtatatattcctgtgaaggtgtacctagaaacaagtagccaaatcaattaaggactttgtaatttcattcagagtacatcagcttcttagcatgttgtcctcggaaaacatggataccaacaaaggaaacatgtgagtttgaatagtttcagaatccatcacatacatagtttcttatggttttttttttgtttgtttgttttgttttgtttttttcccagaatctgaccttccatttagaagcactagaagaagaggctttgggaaacactgtggggggtgaaaggtcagaaaccagagagttctaggtgtcagaacatgggcaggcacgaaagctgcgattgaaacatccagagctccagttacataactgcctctccttctactggggcatcaagagctggccagtgtcattagtaatgcttccagcccttgagaatgcttcctgaatttccactgtagacattttagccttccataaactgaatttccaagttttataatcctgaaactttagttaagttcttgatgatcatacttaaaatagatataaacctggataaatcccagtgatcaagagactcaatatggttctttattattattagatatttactttatttacatttcaaatgttgtccactttcctgctttcccctctgaaaatcccctatcccctcccctctccccctgctcaccaacccagccacaccctctttcttgccctggcattcccctacactgtggttcttaatgtagcatttacagcttaatcattttgattcttaattagcccaattaatgtggaggttatctggaataaaaagtccagcatatattgtctatatttctgtagttacttccatcaattttcttttcaaatactggatcctgaaagaaaacccttgagttttctagtagactttgtatcaattatatgagtaaagagaaatcctagatctgacaccagcaagcctgggacccaatgactgctgtcttattttaaagctgcatctataaatggctttatcacacatgttctccagtttaatttaaaggctacattgagaaatagtttcaaaaatctcaaatatatgtacaggaacaaacatttaaaataaacttactccacattctttgtccagtcgggagggttactcattgtcataaatacacagtttgtcaaaatagtgcacatgattaacatgctgaataatgtaggttagtgttaaggaacatacaaaagaaagttcatgcattgtattaaaaaaaaccaaagtaacactgaaaaacccagacctcagttcaacaggactcatgggtaaacatgtgcacaaatactacctaatctccttacatttcactcaaatttcatatgatgctaaatatgcatcatagtgtgacctccacaatttcagagtaaatgagagtatggaaggacataagaatacaagttgctattgcggttgtttttataccagcatgattaccttccaaggtgctttttctaagcgggaagtggaggtggttgggggggtggtggatgcatttctctcttttaaaatgtatttaaattttatttgcaacattgttgagcagaaagcatggatgtgaattaattgcacaattagaatagtaaattttcgaggaaggtgcatttctgcaataccgagatctcgtcgttaatggatagaattttgacgtcacggtcaaagcagagcgtggtgcagagtgctaagtagccgtgttttgagtgagtttatgtaagcacaacagcatgagaagatggaaggggagatgtgtgaaggtcagggctcatcgccactgggatgtaattgaaattccacagtgacacctgttcttgggccaatcggtcacttatcctttctgtgccttcaaccaccctctggctccacctacattcaacacccggatgttaagctggacagactttgttattggtcgcgtagattaaagtaatcagtgagtatgaaatgctcggaagcaatgccgctggagaaatgtgtacgcactgagtggtaggtcagagaagaacaggtaatagggccattgaaagtggctgtaaaaagtgttttagaaatgccagaaataaccgctacgtcctggagaaaacagatgatccgcaggatcttaaaatatgtgttttctgtcttagtagcaggtattctttctactacactcgactaaccacacaaaacatttccattaggtgtagggaaagatttcatcaaatgaccacatgatggcactagaaatgcaaactaagatggaaaagcttttgagtgagcataggcactttttataaggtacatctttagtgttcgatgatagactattaataggactaacgatttacttgtgatcaactggactcaaaaagaagggcctttattttttgttgttgcttttattgtttttgttagttattattttactttcttgttttgttttgtatctccttttgttggtgtagtgctgtttttttgtttgtttgttttattttttttaaatgaacgtttcttctttagtcattgttttttgtagtgccagggaacaaatcaaacccagagccttgtgtttggacaactctttagattttagaatttgtgattttaaaaaaaatcttgctagtatgaccttatgatacttacaatagtatttttatactaattgtgaccaaggccaccaaaagagactcagtcataaatgaaggtttttcactgatcaatatccacgccggaactgagttgcagaaacctttaaacccaaaggcgaccacagaggcaaactcccttcaaccttttagaacagttttagcttctttcctgaatctgcactaaagagacaatgctatacaacagacccatatattctgtggcttaaatctgatattcagccaacttcataaaactgatcagaaaagttgactaactagctaagcctgaagtgtcttgagattcttataagcttacatgatccccccaaaggtctttaaaatggcatacatcatatctgtgtctaatctgtattttactttgaaaatagtttttttgtgtgtgattaattttactgaaaattttatgcaactctgtacaaagatgttgacaagaaacatggcgatcttgcacaaaacttaggggattcaatacatatatgaaagctagtgttagttgtcaatctgacagaatctagaatactctaacagacgggcctcattgcatgtctctggggaattattgtgactgctttgttaattcagacggaaagacccatctactgtggctggcaccgttccctggctgggatcctggaatgtagactagggttcagggctgaaggggtgccttaatggtagggtgtttccctgacatttctgaggccccgggttcaattctcagcactacaaaaacaaaaagagatttccttgaccaacaaaagatattagatgaaagctatagagtatatgcacatttttttaacttaataatacatagaagacacaatgaatacaaacagttaacaccaaccacttgcaaaaggatatgagtgtaccaaaatcttaatagctattttcctaagaggattgaagggtgttaaaatgtacagggcggaggtggcactgaaccggaagatggccttccctttattcaatactataaaagtctgtaaaataggaataaacacataagtataaaacagacttcctattttccaatagggttgcagtgaataattccaattcagatgcccaggacaatcacttttgatatgtaccatgagtacagctctctctggtcacttatgtcccagagatgaacttacagtggctcttaccttccaccaaccacttacctgagtttgtgcatcagccacgagaatgtcctcatttccttaatattttaagtgtcttacttaagccaaagtttgaaatggggacacatttcattttcatcctaacattcacaagaattccttctcataatgatttgtttgcctagatgaagtatcaggaaaatgaatcctgcaggatgcaaaatcattcaacagaaccgaatgttttaaaaataaatattccttcactacccgtgcttataaaataaacatcatcgctccgctggtaatagagaacaaaagcagcttccatctagcccgcacctattggatggatactatccagtcattgatttctgcaggacaggctccctggagagtatcttgttgaccaggagtgctaaattctgtattgggattcctgaggtagctgacacttggtttctaatcccaattgactctcccctgtgtggaggaaaagctcaaggtccctggagaactcaggacccataaatatgaagagcatctacgacaagagtcagacttactacacagcaaagatcagtgtgcagagggaaaagactcaccatgcaatggagcaacacggcttagtctgacacagtcttctaagtcatttactgatactcagcctaggccgagatggatgaagctgacatctctgtgaataacacactaaatagagagaatgctaaggtttgagtttattttttttttagtgactctattctaattcctaagtatggggaatgcaattaaggcctcctgcatgctaagcaagtgttttaccatagggtcatgttcccagctcagggtgtgtgtgcacatgcgtgtataatctataaccaacccagagtgttatacaagggatccaccaccgaatgctgtccccagcacagcttttaatatgtttatgcatctattccttaaaactcccatgttttagccttttgatgcatagctctatggaccctgctatgattagcacactctataacgtgccgtttgttttctcctgagcattttttgatagcatttcttcttcacatttaaactttaggtcactaacatgttttcattttatttttcactttgaccttgagattttcaaatggagcaatccttgaacacagagtttctgtttgaaaatagccctttctctctgggattcaaacagaaaagctctaaatgtactatgaaaatatcccctaagtagtggggatctgttagttttctcagctgtgacacacacacacacacacacacacacacagacaaaatccaactactgagagtaaaacctgtgtttagaaagttgtaatgcaattttgagtctgttgaaaatgatgataaaataaaacaagagactgtaggctgggctatcccatttcatttcagttacttagcaattaatgtcactgtgtcatagataaacagagaccacatcacctgggtgggaaaagtgctgcttctctaagcctgacctttgaccacatgtcatctaatcatcactgaatgggtgcatccagcacaagggagacgaccttaagatgtctgtgagggaggaacgcactccagtggcaatcgcttgtggttggtacatagttcccgttattctctctgattcattcaatatttttgtccctaaacgaccttgtgaaagcatcataaaacatgaatggacttgggtaagggaaatatccttgccttaaggaatgtgagcatccaaggacacagaacgagcaaagcttaggaccaatgatttttttcaaagttcttgcctgtacctccttatccagaaacacagccagtcaaatgtgatagaaatattgggggctagagtaggaactgtagttaaaaaaattgtaactagaaagaatatatactcttcacctaagaatctaatttcatatattactatagaccgattttgaaatgactatggtgatagagatgacaaacgagtttcagggttactgtagcatcttttacaggctggaggatgagtcttgggagggtcagtagtagttcagtgggcagggaaattcccaggctcatcccattgaaactggctatactcagaatcgcaatgacacaggttccttggcaaccttctgtttacatgatgagtaaaggaagctgtagtggtttgaatgagaatagccccagtaggcatgtgtatttcaatatgtgggcctcggatgtcaaaactgtttgggaaggactttgttggaggtcatgtgttaacagatgtaggttttgaggttccaaaagtccaaaccaacctcagtttgtgttctctctgtctgtctctgtctctgtctgactctgtctctgtctctgtctctgtctctgtctctctctctctctgtctctctctgtctctctctctctctctctgtgtgtgtgtgtgtgtgtgtgtgtgtgtgtgtgtgtgtgtgtgtcttattcatggatacagtacaagctctcagccactgttccagcaccatgctggcctgcctgcctgactgctgtcatactttcccccatgatggtcatggactcatgcgaacccctacaataaatgctttccttttcaggtttccttagtcatggagttttgttatggcagtagcaaagtcaccactacaggaacacttgacagaaaatagaaaagagaaaagaggaagcagggacaaaacaggaattattagtgaggccaaagctgagactctgaaacttagcaagagagaaccaggagggaactttaggcactggaactcagcaaagcagtgttggtaatagctcggcaaccccagtcctgattaataattgaaaatttggacgaccagtggttgaacaccttgacataattcttaaattttcaaaggtttctgtcctttatgatatatttgatacatctatttattaaatgcaaataatttgtaaaaacatgttgcataaagaacttcatgtgcaatgtaggtgggttgaaacaggagactgatgagctttgactgcacagcatgctttctgtactttaatttttcataagatttcttcccacccctgccaaggactgtaacaatagtgccagccttgcagaaccactttcattgtttcttacccaatgatagatatattccttttggattgaaacatacatgcaaatgcgagcttcctacacatcactctgaagtgtttatgggtttagcttcaatagctttgcaatagagacagtattcagacttagatagcacctcattatatgtaggattgtagtcgttatgaagtcattaaatttgatttagaacttaagtttactttttccaactggtctgctatttatttttttacccgatagtatctactatgttcctcacaactttactatagttgagaagtcaggttacaactgcagtgccactcagaaataccgcactgaaggcactgcatggaggaaagagaaaaggatccaaggggatcaatgttcacttaaaacaaaggattaactccaaagctaccaaccacccagacatcccccttctctatttacatgtgcaaattgcccagtggcaagcaccaagagtgtaccttttagtagaaggtactaaaccttctactaaacctatcccttgattcatttattataggggggggggggataaatgctttaatctcattactgcaatggagtagaaatataagcacttgatgagaacattttaataccagaataattttcttccttggaacaagtttttaaacaaggcacaatgggtaaattcagatataacctttatgtataaaaactggtttatagatgtatttatgggaactaagtattcctacttaggccttaggacttttccggcgtgtgtgtgtgtgtgtgtgtgtgtgtgtgtgtgtgtgtgtgtgtgtgtgtgtgtgtgttaaaaaatgtctttgtaatatttatatgacaaaaatgaagtcatatgctctaatttaggtgtaaaaggtgactgattagcactatatttgcaaagctttgtgctgcattctgaaaagaaaacacacatatctaaatccgggcacttgcaaaggaatgctcagctacagatagtagcacagatgaatctagaagacgaacatatggaggtgtagatagcttagaactaaccaataggaacataatgtaaagacaaacctgtactttaaccaaggatttctgattgtctaagtactacatgaaaagccaaggaagaggtgaagtgcgtcttactggtgttttctgtaactcgacaacatttgaggataacatcatattaaaaaaatcactgaggtattttatgtgatttttttcacaatgtctccagtcttctcaatctggtcttattctattttaggtacccgtagccatactagctgatgtctatctactgtgctgaacagatttgacctgactttcaaccactcattgacagaccaagtcacactcttcagcaacccttgatggaaaaatattatttcaggtgttaaagaaaagcataaggtggtttgattgaaaaccgataagcatccctggtaatcaacagttttaatgacccctcccctcctgccaaaacaaagaaacaaagaaacaaagaaacaaacaaacaactcaaacctcagggaaaaataacagcagatttgtctcaagttaagagcaagagttttgtgaagcaacagttttgctggttagcgattaatcagtagtgattcgccagttctcaatggttatacaggatatgtggactgggcccttctgcttgctgtgacctagtaacttcatagaacatgactggctgctgcgattactgtcagggatgaaacttggatttgacaagtggtgtatttgcacttttgttttctgaatatacagccattggtggaaactttatttcaatcaagagcccatttaaaaaaaaaaaaagtatacagttataacttaagttctaattttgcatttcatctagacattgccagaaagctgtgacataacagagattacattgaaatgtactccattccctctctaaaagttagctacaggcaaaagtcagagataacatgtgaaagtgagctggatgccaggcatggtggcgcacgcctttaatcccagtacttgggtggcagaggcaggtggatttctgagtttgaggccagcctggtctacagagtgagttccaggacacccaggcacccagggctacacagagaaaccctgtctcaaaaaaaaaaccaaaaaacaaaaaaacaaaaacaaaaacaaaaagtgagctggataactagaaatattttaaaagctgtacatccagatgtggagcctcactcccgtaaagctagcagcccaaagctaaggcaggagtgttgtgagtttgaggcaagattgagtgctggaataaaaccttttctcaaaagaaaaaccaaataaatagtaggtgttataagcagactaaatatattctttgcctggaactttaaatcacaggggatttttaattcacacatcatctgccttctaaaaatgtatctggcagtcaattcctttggaattttaatgcagtttcacagaagagagtaaataaatatgttcttttttattgtttttttttttgtttgtttggttggttggttttatttgttttgtttttgttttttgtctcaaactcaatgtaactttcttccccaggtgctgggatccaagccaggcccaacaagtgctaagtaagcactcctccagtgaactattcccaggccttatgtaattcctaaagaaatataattatgaattaatggtggttggaactgtatcactatgtagaaggaagtgccagtctggaaatagtaacatggctctaagttgggctcaggtgcgcatctctactctgtaagactctggtggtcagactgagaaactgccctaaccctatcagggagtggggcacatttccagaggttccgcagtaaggggcgggggtgggagggcagaatgagagtcatgtaccaacatagcgatgcttcaaagtctgatgcttcaggtagtcagagattcctgtcagtctccatctccgtgaacatttttcattcttgtccaatccatgcgtctaagtctttttccctctctgagaatctttaaatggtctcctttcctcctcccctcctcttttatattcatggcttcaaacaaagattttcctctttggctcacgagggatgacaagtctcctcacagcttacctcacagcatttgcttctcggcagcaggctaacctcaattaatctaacacagcctccaccaagttaatgggtaaggtctttaagccactgattacaagctgaaatgaccagagagtggaaagagggaatgggtatctgagagtcattattgtcacatttataaactttgggagataatttaaaagttaaacagtattgtgcaaaaatagcaaaaattatagatatcagtacttcacaattaacttaagttttaactttggatctactctcatacaaaagagcgcactgtatacagagggaagattctgtcacatctatgttttctcaggttggaagagaaagcagggcagatggagggaatgctatggcattatttgaattgacatttttttgggatctcctaaatgatgcccttcactaacttaaggccatcatatgatagaagatctattgtataccctgcaactagagaatctaacctcctcctcatatgacaggccagatgctctgttagcatcttctatgttttcctttttacagaagcttgtcttcgcatctaaattcagatgtcatttcctttcagaagcccaccatttaagttttaagtgtagttgaattgtattagacgctgatactgagcatggaagatttgtttttacaaagcaggggtttggcaacatgccagtagcttacttattagtttttgcaatcttagacaaactatttaacctcagttttattattctgaagttgagaccaaaactgtcttgaaagaacctgtaaggtaccaacatgaatttaaaatgcaagtgcataatatatagggaggtagcagttgttcatttttacttatctggaataacttctctagaagtttctatcttctaattgtggagaacatctctgctccactgtctgtccttgtggcctaaatacatttgcctcattctttaggacgtgattcagcatgtgacccttacctggtccagaattcttgctcagagtttggaaaacgcatgcacctatcctcaaggttactctgctgtagatgttaacttactgtaactggggactatttttgccatgtgtgggtgagcccacctatgcaggaagccatcacagagcaaagcagagcctacactgtccatgggctgtcctgatggtgtcagtttagattccacgtcttttgttattcaaactagacttggcccataagtttgcttttcttcttcttcttctccttcttctccttcttctcctcctcttcctcctcctcctcctcctccctcttcttcttcttcttcttcttcttcttcttcttcttcttcttcttcttcttcttcttcttcttcttcttcttcttcttcttcttcttcttcttcttcttcctcttcttcttctgtctctccttcaaagtagtttttgctgagttttggttacttttatccaaagggtctcttaactagtatgactagaataaactaaatgtcaaaggtaatttatttgtcctgggacattttctgaggcagaggctaagggctgattttcctagaagaataaaaccttcctcaccctaactgaaaacaaaataagaacttggtacctcaatcatagacactcttgtgatgacagatgagatataaattggaagcctcttatgtgaaccccagtagagagatagtatccatcattttaggtctgttggtggagacaataggttgtttttaatgttaggaaacattcaaggacacagtacagtttttaaatgaatacatttctatattccaaaatataacaagcttctattttcactgcagatctagaatatctttctatttctagtcaaatgccacattgtcaaaaggatatttcttcccatggcactaatgagtcatctgtaattttaagaacataagaggggagacgttttctgaacaaagagtgggtgaagctgaatgtataggcaaatggtacagtagtagctcaagttatgaaaccgacaaaaaaaaagtcccataagaaaaaattgtactcacaaactgaaatgtccttgttacacaaagtgaaggaacaaatagaaagtattcagcttcgactcataccttaaaggtcccctgaggacagcaaccatgagatggaaactcagtgcattgcaactttgctatctcctttccacttcacggttgttactgtttctttcattgctaataaaggatctctgatcacagcttaaatcactttaataattttagtagaacatttgattattacataatttgcagatcagaaactgggtcaaagaggataaaaatatgtgggcatatgtcacgataacatataccactgtcagtgacatttccactagcccaatggcattggttatctttataaaaagaacacagagagccctggcatgctacagtgccttcacacagcactctgcacatatggtgcacctgcactttagcctgaggtataccataaagaatacattctgtaaccattgtcatggtcaatgctattgttcaatatttgcccttcccaaaactcataaattgaattattccataatacaaggtgggaatatttaacaggttattggttaatgaaggctttgccttcaagaatgaattggtgcctttccagggtaagataatagacccttcttgctcctccttgccttaaacccttccaccatgtgatggtttagttcctcaatcttggactctctggtctccataagtttaagccaatccatttcttttcattataattccaaatgttggatgtgatgttacagcaggctaaagggtcttagagatttggctttttaaaatcattttacatattgctaataaatgagcatgatgatttatataaaaataactcattaaataagttcaatctaagggaagccattgatgtttgcatatttcaactcaatcttcaaaacaaatccatattcacagtttttttcagtcatggagaatctcacccttaatgatttttgaccagtagaccccttggctgcttcaactcattcacttttcccctcccttctaccctccttccctctatgtctcccattctctctctctcattcatatatatatgaaggctacatagtagtcactaaaacaaaattagtgatcaaatattagaagaaatattcttttaaaagactgagatttttactaagcaacttcaatgtaaatcagagaaaacttaatgtttatgaagattataccataagaaaacaatctatttatgagagaaaatttaagaccagtaacataatatacaggcaacctaaagaaggttttaaaacagagcactatgaaagaaggcaacattctgaatgtggcttggccatgtgttctaaagtactctatgctggacaagctgacacattcctacaatccctgcacctgtagaaaggaggagtgtgagttcaaggccagcctgggatacatagggaattgctgtctcaaaaactaaagaatgaagcacatagcgtgtctgtttaaaaaacaaacaaaaaacaaacaaacaaacaaaaaaatcttagctctagaaatgtctacctgcgctgctatccagtggctcacatctggagatctgtttggtggaagaataatgtgaaaatgaaggacatgcctttcattggaaaaactccttcctgataacaatatctctcctatcaggttgttctgcttgcacaatgtgatttgttccaaaatgtctgaatgtttttccttcttcacacaatgtgcatttgaagataaggacagctgatgtcaaaggcaggttgggggcaggggtaggaaagctgatctggctgccaagtcatcagagctgggcttacaccttgagctttttgtaaaagctttaagtatttgtcactgggttatgtgattttgttttccattttcctttatgccattgtttttaaaattttaaattcaaaataacccagtcagggaccatcatgggtagaaccacccctcaaaacagtatctttcatcaatttaaaagctctttgtttttgaaaacatattcttttgcttttatttttattatttgttgattggttgattgattttattttatttttttaagacagagtcttactattaactttggatggcctggaacttgctatttaaatcaggctagccttaaactcacagtgactctcctccctctgcctcctaattgctgggattaaaggtgtgtacaaccaggcctggtagtctggaagctctttaatttaaaagacaaaaaaaaaaaaaaaaaaaaaaaaaggatctgatagtttgatagtttgtatggtgatttgagtaagaatggctctcataaactgaaataattgaatgctcagtaatcaggggagtggtattacttgagaaggattagaaggtgtggcttgacatagttatggctttgatggaggaagggtgccatggaagagggctttgaggtttccaaagctcaggctaggccaggcccagtggttctctcttcctgctgcctgtaggtccagatataaaactcttagctacttcttcagcaccatgtctgcctgagtgctgccatgctcccagccataatgataatggtctaaacctctgaatgtgagcaagctccaaataaatgctttctttttataagagttgctgtggtcatggtgtcttttcatagcaatataacactatgacagtctggttaccacatagtgaattactatgctttttaaagtgtttccatttggtcttttattcctttatagatttataaataaggacatcgtataggggctgggatactggatttcaattttgtattttgacagggcctcctcttagtaatttttatcattaataaatcacttttatttatctttgtttctatataaataaatagtaactattaggtggtggatttggtctgtaaattggaggtgccatgtttgggggagtaaatacctgatgaggaaaaggctttctaacctggaccataggagcctctgaaacactgcatgcccccccgagaattgtaagtaaataaacacaatccatgagatgaaccaatttctatgtggaacacatctggatctttattttgtaatttcctcatattcacttctgacaaatagcaattatagaatgaacaatctcctaaattgactacttttatgtcaccttgacataagctacagtcattttggaaaagggaacctcagttgggaaaatgccccttctctagattggcctggaagcaagcctgaagtgcctttacttgactgatgattgatgtggcatggcctagcctgttgttgtagtgccacccccaggagggtggtcccaggtgctataaaaaaaataggccaagcaagccagtgagcgtgctcttcccccgctcctgcttcagttcctgattccaggttcctgccttgattttctgccccagctttcttcataatggattgtgatgtagaacggtaagctgaaataaatcttccctaccttcaagttgtcttgggtgtggatgttttatcccaagaatagaaactctaactaagacatttctctcaccccaagctaccacatatggcagcttttgtcctgacaggaactgggctaacagtacagtgtccctaaaagtttggagtattttaggattcgtggtcaatgaaacacttgacttgcttggttatatattcccccaactttaacaactggcaagtgtaattggctagatagtgtcttcaaaaagttcaagccagtatgaaactgtatcaatcttagaaacagagtctttgtagacataatatggttatgatatatatgcatatatacatatacgtacatacatacatatatgtgctgaaatggttgaattgcaatatgcccccaacaatcctatatatgtgaactataagccaaaagaaatcattttcccctaaaaacaagcaacaaaacaacaataacacaaaatacccatgtatattgcataactgtattccatgtggaaacgattacttaggaagttatttattatttataatatggcatagaaataaaaacctcttgtgttgtaaaacttccttccatgagaaattcacacaatatatttttaggtctttggtaactcagggtgacttcaacatttcaaggtacaaaaaaagtacttaaaattgcttagtccttgtaatcttcagtgagagtttttttttaatttgttaaattagctgcctacaaaatcttatacgtatatttagatttctgtcatggggcatttggggcagctccatatggtataatataatttatttacttcttatgaatatgcataaaccacccaccaatctggtctcatttcttaagcagagggattgttaagcctgtgctactttagtatgtgaggtttctgtaacagtccaatgtaaatgtagttagtggcaaagtatacctgataaaaacacttaccttcttattgatatagtaggggtccaggtcctccagaggctccgacaccatctctggaggaatgtctccatagataaatggaaggttcttcccagcttccaagtcactgtttggctttgggccattttcatcatcatcttttttgtctggcttgggattcttagccttctcttctgcaatgcgcctttcaatagctgcaagggattctctggtgaagaagttgaagctgtcaggtcctggtggtacaagcactgtttgctccatcttgtcatcctgcacattttaattactctttactcttcatgtgagattcctaaggagggaagaaccagaaacgtggagaacattaaaagttatcaatatcaataaatactcatctagaaaagtgggccagaagacttaaatttttttctcctccaaaatttaaatggaaaaaataaaaaaaatgtttacacaaattcattctctatgttgagctttggccaagcattcttgtatgtttaggattgtgctttaccaatagaggaactaggctgtgagtttaaacactggttcagtattgctctgagtacattttgataattgtcgccacatcactgataaactgttcactctgagatgtacctgtatgatgaagacgatgcccactgatagatcaatcaattcaaaggtatcacacacacacacacacacacacacacacacacacacacacacacacaaccaaaaaaaaaaaaaaaaccggaaccttgtctctgagatctaaaatgcagccattgaggcttaacaagtaaggacaaagcagtttaactttgttgcagtcaatcagaatcacataaaaagacagtcattgctacactacttatgcctgtgtacaccctgagatgtgggtgaatagatctatggcctgagaactacattagctctagtagagtctctttgacaatgacaatccaaggtgggacaaatgccattaatatggctgagatggacataaactaaactggaaaggaagctatgtgcacaggaggtagtagaaatgttcttagttcaaggaacaatgtacttttcttcaccgaaacaattctgatacatgggagagtctgcagtcctgcagatattaaggccaaatccaagatgcatccttttaaaggtatacttaataagaactcaaatttcacacatatatctgtgcccaaacttcccagagctcaagttctgcctggtacagactctgttttaatagtctgttagctcattaaagtcagcaagctcaatacaattagttgcagctttgatgtctaggtctctaatagaaaactacagcttcctcttcctctcctcccagtgttctccctccccccattcacctttccatttcttctcagagaaagtgaaacctcccattgatatcaaccctcctcccccaaccttggcatattaagatgtataagactagacatatcttcttctattgacactagacaaagctgtccaattagggggaagggatccaaagtcaaccaatagagtctgagagagcccctgctcttgctgatagagatctcacatgaggaccaagctgttaagctcttacatatgaatagcgggtcatcccatgcatgatgtcttgttggtggttcagtatctgtgagttgctatgcgaccaggttagttgattctgtaggatctcttgtgttctggatctccctggctcttcctctccctctttgacaagattccaaggtttacctaatgtttggctgtgggattctgcatgtattttcattagctgctgcatgaagccactcaaatgaatgttatgctagcctcctgtctgcaagaacagcagtatgtaattaatagtgccagaggtgggctccctctcaatgcaatggaatcactgtattttatctcactcattcattcagatcatcctgtctaggtatccctctcacctacttgatggttttgagtctaaatgtgcattgaattctatcttagtgtgtttatttgttcttctccttttttttctcttattctataaaccctatcttttggtttgtttatgactgttgagtttggatctcagcatgcaccaaaggtggagtggaacttgctccatggctcatactggctttgaaattgcaattatcatgttatactttcctaattgtttggattgtggtcttgcaccaccatctctgattttattctatcaattctagtgctgattctacttatttgatgtgtagataatacttatgatctgatatttggaagtgaactgaactatttacagccttatgtcacttaaaagcatgagtatatattgagaaaaaaatcagtagatgattttaatgtggaaacataatagaatacttaaatggacttacgtagtatagacaaatcactcaacattaatgcatcaaagagtccaatattcacgagacgtatgaagctgctatcagcacagtgtggcctgctcttttattaccttaaacatctttattagtagaaatatactctaaaatatgattaaaaagaatattatagaaaatccacaaactcttgacagagctgctgttatcatcatcgagtgttatgatacaagcataattgaaaggctgccatgatctatgggactggcagcagaagatgtctgtggatgccaccattacctcacatgtcctgtgttgtgccatgagtttaggatggatacatgaataagtattgggacttctaagctccactcatggagccagctttgagttgcaatctgtctgtgaccaaggcaccagtgtgcagtgcttgataatcctgccgagcacatagatctttgcttctctctctctctctctctctctctctctctctctctctctctctctctctctctctctctctgtctctctctctctctctctctctctttactgagaacaaacgtaaacacatatataagggcatttgtttgtttgttttttctcgtttgtatttctttgctgtttcataggtttagcattatcttttgtatgcaaatatttaaattttggattgcagcataatttaaatacatactaattgcatacaatttcagtctttctgaaagggtgcaacaacagggtccatttttcataaaattgtgtggacagaacagaagtggctacttcaagccttcctattcagtaaaaatgagcaacccacaagacctaacagtattatggtgtgcttacagccaggagcctagcatgtctaccctcagagaggcccaaaaagcagctgactgagacagaagcagaaacttacacccaaccaattgtctgaagtcagggacccctgtggttgaattaggaaaaggctgggagaagttgaggaggagggcgaccccataggaagaccagcaggctcaataagcctaggctcttgagatctctcagacactgagccaccaaccaggcagcatatactagctcatccaaggtcctggacacatgtacaagtaggacttcctggtctggcctcagtgagaaaagagcccctagctcttgagagacctggggctgcagggaatggagagacctggcaggggtgttggggggagtgtggggtgtggagaccccttagagatgggggtgggagggtggggaggagaaatgggatgaggaactgtctgagggcagaatgggagggggataacaacttgactataaaagaaaaatattaaatataattaaatataaataaaaagcagtataagaaaaaatgaaaaaaaaaaaaaaccttagggctattggctgtcagtatcaactgagtaaacaaacagccaaaaagataggcaaatactactgatgaatatgaccacttcaaatttattgttataataatgacctggttcagttacagtaattacactcatatgtgagtaatttaactaaatactatactgataacatattcaggttagggggaaagtatttcttactttctgattagaccttgtattcaaatactaccaaaaagtaaaacataagttatattaattataagaataataccatttcaagattgtgatctggggctaaagagatggctttgctaaaggtgcctgttcatgcctggtgaccttgagcttgctgtctgccccacagggtggatggagatgactgattcctgtgagttctcctctaagctccaccatgccacttttccatctccctccctctctctgtctctctctgtctctctctcttaaacaaacacacaggtacacacacgcacacacagatactagctaagtaaacaaataactgtaattttaagcatgatgacctgttccataaggttgcttatgaaatatctgaagctgtcaaatatccttcaatattaatgttttcaagcaatattatgggcaaaaatctatagattttagtttgaacttctactttctctatccagaaataaccattaggatagaaagaaaaagtttggatttttaacttaaaatttttaaacatttaaactgaaaactgagaatggtccccatttgtggaaacacatgcctcattagagatgtctcatttgaggaccatgtggcttgaggcttgtggcggtctctttactttagtgtgactttggatgccttggttacatagagcagcccgtgtacccttcagtagagatagccaacaaatcgtggtaagaaaagtgtcaaagagagagtaatattttaaagaaaaatataagataagaacttattcaaaatgcaaactcacatagttatgaagaaagaaaaatgatgcatttcattaacagacatacttaaaataataaaaagaagtaaattgccaagaaaaaaatgaattattcttttagaaaatacttttaaaaattaaatatagacaagtcattcgaaagaaggcaacaagaaacagtaaaatctcctaaagacactggaatagaagtgaggacctgagggctggagggatggctcagaggttaagcgcactgactgttcttctagagggtctgagttcaattcccagcaaccacatagtgtcttataacctctgtaatgggaactggtgtgtctgaagtgaataccacatatgtactcacatacataaaatgagtaaatcttttgaaaaaaataagtgaggaaaacatttaaaactaataaaaatttaattcacaatgggaaaaacagggatgaaagagaaataagaatgaattacttcattcaaataggaaccttctggctttatcgtcaccaacaattcatactttatcgtcaccaacaattcatactttatttctataacttttaaatgtttttctaaacctggtaatcccagctatcagttaatatggttattcaatatcagtacatcttagctatattatgccacataattttatgtgtgaagcaatgctatatgtgtagtgtcttctaaaatagcatggtatttatagtgaaaattagctggattcttgctaacatgatggtcagctcctgcaagccttaccactattttgaggacatcagtcctctagatagcacccttcttaattaaatttttggtctactttgcaaaatattctactgccaaaaattaaagtcaggtgaaatattattcttattgatattatctcacaaaaataactaaaatatttattagtgtgtgtgtatgtgtgtgtgtgtgtgcctgtgtgtgcacaagtgcattaagtgtgtatatggagacttgtgcggggcataaaactggaggtcagagagcaactttgaagagctgcttctttctttgtaattttatgtaaattcctaggattaaactctagtcaacaagtgtctttgcccactgagccatctccctgatcacttaaccactgactaattctataaggcttgcattgtacttagtgcattctttgttcttgaatcaaaaaccaaaaccaaagggacacaaattgaaaaggaagatgtcaaaatatcactatttgcagatgatatgatcgtatagttaagtgatccctaaaattctaccagagatctcctaaacccgataaacaacttcaacaaagtggctggattataaaattaactcaaacaaatcagtagccttcctctactcaaaggataaacaggctgagaaagaaattagggaaacgacacccttcacaatagttacaagtaatataaaatatgttggtgtgacactaaccaagcaagtgaaagatctgtatggcaaaactttaaatccctgaagaaagaaattgaagaagatggaaaaatctttcatgctcatgattggcaacattaatttagtaacaagggacatcttgctgaaagcagtctacagactcaatggaatccccataaaattcccactcaattcttcatagagttagagcaatttcaaatgcatttggaataaccaaaaacccagaataatgaaaattattctcgacaataaaagaacttctggggggaatcaccatccctgatctcaagctgtactgcagagcaattgtgatttaaaactgcatagtaatggtacagtgatgggcaggaagatcaatggaatagaattgaagatccagaaatgaaacccacctacctatggttacttgatctttgacaaaggagctaaaaccatccaatggaaaaaagcattttcaacaaatggtgctggttcaactggcagtaagcatgtagaagaatacacattgatctgttcttatctccttgtacaaaacacaagtccaagtggaccaaggacttccatttaaaacaagatacactaaagttaatagaagagaaagtggggaagagccttgaacacatggacacaggggaaattttcttaaacagaacatcaatggcttatgctctaagatcaacaattgacaaatgatatctcataaaatcgcaaaacttctctaaggcaaaggacactgttaataggacaaaaggcaaccaacaaattgggaaaagatctttactaatcctaaatccaatagagggctgttatctaatacatacaaagaactcaagaagttagactccctttactacagagcaattgtgataaaaacagcatggtactggtatagagacagacaagtagaccaatggaatagaattgaagacccagaaatgaacccacacacctatggtcacttgatcttcgacaagggagctaaaaccatccagtggaagaaagacagcattttcaacaattggtgctggcacaactggttgttatcgtgtagaagaatgcgaatcgatccatacttatctccttgtactaaggtcaaatctaagtggatcaaggaacttcacataaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatctttaatcatcagggaaatgcaaatcaaaacaaccctgagattccacctcacaccagtcagaatggctaagatcaaaaattcaggtgacagcagatgctggcgtggatgtggagaaagaggaacactcctccattgttggtgggattgcaggcttgtacaaccactctggaaatcagtctggcggttcctcagaaaattggacatagtactactggaggatccagcaatacctctcctgggcatatatccagaagatgccccaactggtaagaaggacacatgctccactatgttcatagcagccttatttataatagccagaagctggaaagaacccagatgcccctcaacagaggaatggatacagaaaatgtggtacatctacacaatggagtactactcagctattaaaaagaatgaatttatgaaattcctagccaaatggatggacctggagggcatcatcctgagtgaggtaacacattcacaaaggaactcacacaatatgtactcactgataagtggatattagccccaaacctaggatacccaagatataagatacaatttgctaaacacatgaaactcaagaagaatgaagactgaagtgtggacactatgcccctccttagaattgggaacaaaacacacatggaaggagttacaaagacaaagtttggagctgagatgaaaggatggaccatgtagagactgccatatccagggatccaccccataatcagcatccaaacgctaacaccattgcatatactagcaagattttatcgaaaggacccagatgtagctgtctcttgtgagactatgccggggcctagcaaacacagaagtggatgctcatagtcagctaatggatggatcacagggctcccaatggaggagctagagaaagtatccaaggagctaaaaggatctgcaaccctataggtggaacaacattatgaactaaccagtaccccggagctcttgactctagctgcatatgtatcaaaagatggcctagtcggccatcactggaaagaaaggcccattggacacgcaaactttatatgccccagtacaggggaacgccagggccaaaaagggggagtgggtgggtaggggagtgggggtgggtgggtatgggggacttttggtatagcattggaaatgtaaatgaggtaaatacctaataaaaatggaaaaaaaaaagaaagctcagcactacaaaaaaaaaaaaaaaaaaaaaaaaaaaaagaagttagactccagagaaccaaataaccctattaaaaatcgggtacagagctaaagaattctcaactgaggaatcccaaatggtagagaagcacctaaagaaatgttcaatccgggcgtggagaagcacgcctttaatcccagcacctgggaggcagaggcaggcagatttctgaggtcaaggccagcctggtctacagagtgagttccaggacagccagggtgatacagagaaaccctgtcccaaaaaaccaaaaggaaaaagaaaagaaaagaaaagaaaagagaagagaagagaagagaagagaagagaagagaagaaaagaaaagaaaagaaaagaaaagaaaagaaatgttcagcattcttagtcatcagggaaatgcaaatcaaaacaaccctgagattccacctcacaccagtgagaatggctaagaccaaaaactcaggttacagcagatgctggtgaggatgtggagaaagaggaacactctttcattgctggtgggattgcaagctggtaaaaccactctggaaatcagtctgttggttcctcagaaaattggacataagactacctgaggacccagctataccactcctgggcatatacccaaaagatactacaacatataacaaagacacatgttccactatgtttatagcagccttacttataatagccagaagctggaaagaacccagatgtccctcaacagatgaatggaaaattggtacatttacacaatggagtactactcagcaattaaaaacaatgacttgatgaaattcttaggcaaatgaatggatctggaggatatcatcctaagtgaggtaacccagctacaaaagaaccacaaggtatgcactcactggtaagtggatattagaccaaaagttcccaatacccaagatacaattcacagatcacatgaagttcaagaagaaggaagatgaaagtgtgaatgcttcagtacttcttagaagggggaacaaaatattcatgggaggtagagggtaggggtgacttgggaggaagagaggaagaggagggggaaagggaggcaggattagttatgagaggagatggggatgatatacagaggggcaggaatttgaacagaggtgtgtagcaatgggggatagggaattggggatatccatcagcaagtcccagatgccagcaaagattggggggaatgagaccacccactcatctcaaaattcttaacccaaaagggttttcttgtctaaaggaaatacggggacaaagtgtggagcagagactgaaggaaaggctatccagagactgcctcacctggggacccaacccatagacagacactaaacccaaacactattgtagatgctaagaagtacttgctgacagaagcctgttatagctgtcccctgagaggctctgccagagcctgacaaatacagaagatgcttgcagccaaccattggacttagcacagggtctctgacgtaggagttggagaaaggactgaaggagctgaaggggcttgcaaccccatagggagaacaacaatatcaatcaaccagacctccctgccccagagctcccaggaactaaaccaccaaccaaagagtatacttggagaggtccatggctctagctgcatatgtagcagaggatggcactgtctggtatcaataggaggagaagcccttgatcctgtgaaggcttgattttccagtgtaggggaatgccagatcaataaggtggtagtgggaacattctaatagaagcggagggagtagggatgggagaggaaaccagaaaaggggataacatttgaaaagtaaatacataaaaatccaataaaaaagtagacaacaaactaaaacaacaacatcaaaagaaagaaaggaagaaagaaagaaggaaagaaagaaagaaagaaagaaagaaagaaagaaagaagaaaaaagaaaagaaagagaacaaaattttttttttttaggtcaggatctcttttcctaaccctgactgtcctggaattcattgtccagatcaggctggccttgaattcacagtggccttcctttgcctcctgagtgctgagattaaaggtgtgcaccatcatacccatcctcaaaagctattttgacagaataaagtgctgatatgttctcagatcaagagcctaaaaaccattaggaaattctttatatactatcaatttttgagaaatatacatttgtataagctctgtttttatttgtggatgtatatatgtattttttctgtgttatttctattatgtagtctttacttgcttgaagtttcagtttaatgataaatgccctcttctctcttgaaagtgtcttaaatgtatctcaaatatgatgccaaatattctggtgtaggggagagaatgatatggatgagcagtgagagtctttaggttggtaaggagattgcagggtcataaacaggatgacacagtctaacagggcaatacacccagatgaaaggtgtagcccagattaaaggtgtgttccttaaactcggagattcaatcttctggaatccattgccactatggctcaagatcttcaaaccaagatccagataaggatctccaagcctccaaataagggtcactggtgagccttccaattccggattgtagttcattccaaatattgtcaagttgacaaccaggaatagccactacaatccaccccttgtcaacttgacacaaataatatctcatgttcacatgaaacaataacaaggttgtaaatatgcctaacatgatataactatctctcgtacaatcgcaaatgcattagtaaatttacaatgggcattcactaaaaagacagagaggccaagacgggtttgatgaggtgaagtggcacttcttgatattcagtcggggctgatacccaaatatccacttagttggaggagaattattcacctgggtgtttaacctgcaggcctccccaaccagtggaaatcctgctatgctcttcttgcccttgtataattttgagtaatagacttttgtgctgatggaatgagacttataaactctagtcaagctttctctgaagcactgtgtgtctacatagcctcatgctctaggtcctttgctctgagaatggtatatctcaaatgggtgcttcttcctcagtctggatcctggaataagaagacacattcactggatgtcaagagaaagctaataggactcaaagggtctaaaagtaacgatttatcagtgatgtttgacagtgatattactaacgagcaagtgtatgccattgatcaaagaccaggctgctaaatgagttgaattaattaggaatatttgtctctcagacacaaatgttgccagagattagatattccacacctcatgagtctccacctatagttctagatgaggaacacattatcattaggcaatcagtgaaatcatggccttctaacaatcatatagcaactcaggaaaatttgttcaaaggatgctaaatagcctatatcaagaatacaaagagtgggctggggagtagttcattagtaaagcagttgccatgtaagcatggatatctatgttcagatcttcagtacccattgaaaaagctgcagcatcatccaatgcctagaattccagtgctggaggagcagagacaggggcatcatgtgggcctactgccctgacagtccagctgaatcaagaattttaggttcagtgagagatcatgtcacaaaaactaaggtagaaagcaacagagaaagaagtgtgatatttatctctggtctctctatgcacaagaacacacacacatgctcatacacaaacactccacactcctgggtatatacatgtctacactcatgagcacatacatgcataggcacaagcacacactcccaaacagggatacatacaaaaacacacaacaaagaatatgtattatcaatcagaagccaattatttaagttaagtagtaaaaaattcttctactaaaaagacaaccgtaccatggtgaggaaatggtccagtcaatgatatttgctagaactgtcattgtccatccatgtgtctatgctgcagcatttaagatatcaagaaggagctggcctagtgagaacagaaaatctaacatggctgctatagcttactgactagaagttaagtgcacacttcctaaaagaaggctttgacacaagccacttcagttccctcctcattttcttgtccccattcctctctctgtagaattctgagatttcaattcagttttatacagaaaccacattactgtaagccctacaaagttatggcaatatagctatatggagtcaagtaatgtaggttatttttttcccaatggtgctggtgaaggtggcaattatgtagctatacttagcagactgaggaaattctgctagagtcagcatttgtctcttcattgctatgaaacagtaatggaaaaataaacaaaaacaaaaggcaaacactatgcataattccctcagatcatattaacatgtgatgttggagtaaattgttataaccccattttggaaatacttaccttaattaactatgatttccttaaaataatgcagtatttacaatctatatgaaagcactatatgggacacatggtatgatggaacagtgcacccaagagacaccaagaacattcctgtctgtggcagtcttttctctatacagaggcatttagtctcaattgctcagagttattttacgttttcagtgactttcactgttcattcgtgtgcatattgcctggacaacacaggatgaaaaatggtccaagagaagtctttgacttgctaaagcaagaaagatgtttaaaatatgcgacacatgaaatatcccaaaaagtgtagaattctttttgagaatgttgatgtctctttagcataaagctaatttgaaggtgtccttcttatcctaatattttcttacaaaaccagctcatctcaaagcaaaagtgttcaagatatagttgatggagtaaggagtttagcacacagaacacagggacagctacagagaaacagcaaatagccaaggcagacataaagaggctgacaagacatgagagagaagagtattaaacacagatcagctacctggaaaatggctctctggtgttccacacttcctctcatctggatgatctagaaacacagtaactgctctgagttaagaaagcctgagaccagcagtgtgtgggtggcctgcattaagttgattgataaacattctacatataaaatctgtacccttcacaagtttggtcaatgacacaattctattgtaataccatagactcatgttcaaagaagaatcatttaaggacagagtgtgctgaaagaatgtataggaaataagtcacaaaagatgacataatttcttgatttaaaacctcacaggatcataggatcagaggtgaggaggacacaacatctgtcaaaacacaggaattaactaggaccaatgggacccaggcacacaggaactccaccagatcagtggcacaagttccttctggtctgtctgggtcagtgccctgagcagaccttgggcttgaacttcacagccagtcccacaacacccagaggaagctccactcccaagtgctctaacatgccgaggatcacaggatcacagaagcttggtcacaccaggatctcagggtcccagaggcagcttaactcccaggagctctgacccattcaggatcccagaaccacaggatcacagagacagcttgattctgaggagttctgacacaaccagtatcacaggaaggatgagctccagtcagatatagccagatatatcaggtagcactagagataatcagatggtgggaggcaagcataagaacataagcaacagaaaccaaatttacttggcatcatcagaacccaattctcccaccatagcaagtttggatacaccatcacaccggaaaagcaagattcagacctaaaatcacttctcatgatgatgatagaagactttaagaaggacataaataactcacttaaagaaatacagttaagcaggtagaagtccgtaaagaggaaacacaaaaatcccttaaagaattacaggaaaacacaattgaacaggtgaaagaaacaaacaaaccctccaggatctaaaaacaataaagaaatcacaaagggagacagctctggagattgaaaacctaggaaagagataaggagtcatagatgcaagcatcaccaactgaatacaagagatagaagagagaatctcaggtgcagaagataccatagaaaacattgacacaacaatcaaagaaaagacaaaaagcaaaaagctaatccaaaacatccaggaaatcaaggacacaatgagaagaccaaatttaaggataataggtatagcagagagtgacgtgttccaacttaaagagccagtaaatatcttcaacaaaattatagaagaaaaattccctaaagaaagagatgcccacaaacatacaagaagcctacagaactccaaatagactggaccagaaaagaatttcctccagtcacataatcaaaacaccaaatgcactaaacaaagaaagaattttaaaagcagtaagggaaaaaggtcaagtaacatataaaggcagagctatcagaattacagaagtcttctcaccagagactatgaaagctagaagatcctgggcagatgtcattcagactctaagagaacacaaatgtcaacccaggctactatacccagcaaaactctcaattaccatagatgaagaaacgaagatattccatgacaaaaccaaatttacacaatacctttccacaaatccagccctagaaaagataatagatggaaaacaccaacacaaggagtgaaactacaccctagaaaaagcaagaaagtaatctttcaacaaacggacacaaacataattccacctttaacaacaaaaataacaggaattaacaatcacttttccttaatatctcttaatatgaaaattaatattaccaacatatcttaatgaattgaaattcaaatatatgaggaattagaaatttgtcggctgtcttccagtggtctctctaatttggtaatgggagaaataggtccaatattatacaatccatatacactttctgcttgtttgtatatgacaaagtctagctgtgtaccacacaatggtcttgaaatcatgcttctcctatctcagcatatctatttgtaggattgtttatttaatgtttttacactactctatggttttcagaacagcttacatatttcaaaatcatgtatacagcccaaagaaatatagaaaattaatttgggaggtagcttgtaagagaacaacaaagagtgagactgaacttttttttgatatttataattattgtatcaattttgaagaagaggaccttataagttactttttttctgatatgaatgtttttcagaattatcacagtcaaaggaaccagaatcttacactcacctaatgtctgtgccaccctccaagcagagccattgttcattgaaacaattgatgaatgactccatggatagaccatcttaatacacaccatttcttaaatgaatgtaacctgctccctgtaggctgagaatgatgacaatcactcaagtcaaatagttttgattatagaaggaaatatgtatccaaataatcgtgcctgcaattcattccttggtgcagcagaactgtcaactcttagcttaactactatggaggtaaaatcctttggtgatgtgagggacattgaagtacagactaattacaatgaactccaatatctaaaaattgttcttattttgggtttgtaccacagtaagagtcaagattttaaagctctactaaaaacaaaacaaacaagtaaacaaaatgactttatttatgttcatttaataacatgtcgatcattttatgattggtataaaaatatatattgtgctgaatatgataaaaaattagttcacttaaaaataaaataaagactcactattttaattgcctctatgcagcatttatcatatatgatatcaaattacatctaatttattattcaaaactatactggttagctttcaatctgacagttaaagtcagtcaaccagtgtttcttttgtgatgtactggactgatttatagagacccttctgggattcttagctttctgtgtggtcaccagctaatgactgtcagctctgtacaaaggacacactaccagatgccaggacatctgtcacagcagctaggacacagagccaaatctattcttgtcttgatgtatgacacacaatatgtacaatcagttttgttcattttgaaagtattctttaatatatgctacagacaagaccctgcaggacagtgaagaccgtacggtggcagggggagtggaaaataacatagtattgggatcttgagactaaagcaattttcttcacaagattctttatgaaatcagctctgagattttgatttgttttggaattttgatgtttctgaccttaatggagtgatgtattagtcccagaataggtgaaaatgaaggttaaacatttttggcatcaacttaaaatacagaaaacctcttttgacttcttgagtctgtttgtatgtgtgtgtgtgtgtgtgtgtgtgtgtgtgtgtgtgtgtgtgtgtgtgtctgtgtgtgtgtgtgtctgtgtctgtctgtctgcctatgcatctgtgaaaaggcaaggagcagtaacactatcctgaattattactaatttatttaaaggtaaaagaataaacatcatgtaacctctcttaataaatctcacataaagtggttttttttctaacaatagattcacattttaattcttatttcaattaaagaacttttgatgcattaagctcaaaaccataaacatgtcagataacagaacattaagttcaaggaatatcctacactctttagttctaactagttttgaagttatgttcctttttctcatagatcaaatggtgaaaaactataaaatagtactattaatatacatatgagagatttggtttctgaatctatgccttttctcctactcagcatgtcttctaacattttttggctatttttttattggttattttatttatttacatttcaaatgttatcccctttcctggtttcccctcaggaaacctccattctatcttctttccccctgctgctatgagggtgctcacccacccactcctgcctcactgtcctagcatttccctacactgtggcattgggccttcataggaccaagggcctcccctcctcctgatgcccaataaggtcatcctctgctacatatgtggctaaagccatgggtccaaccatggttggtgttttagtctttgggagctctgggggtctggctggttaatatttttgttcttcctatggagttgcaaactcattaagctccttcggttcatcccttaactcctctattgtggtcccaatgctcaatccaatggttggctacaagcatctacatctgtattggtcaggttctgtcagaacctctcaggagacagctatatcaggctcctgtcagcaagcacttcattggcatcagcaatatagaaaatgtggttacatttacacaatggagtactactcagctattaaaaacaaggacttcatgaaattcttaggcaaatggatggatctagagtatatcatcctgagtgaggtaacccagtcataaaagaacacacattgtatgcactcactgataagtggatattaggaataaagctcagaatactcaagatacaactcacagaccacaggaaactcaagaaggaggaagaccaaagtgtggatgcttcagtcctacttagaagggggaacaaaataatcactgaaggtagagggtgggagggacttgggaggaggagagaagggggaagaggaaaaaggaggcaggatccaaaatgggaggagacaggggagatgtagttcagatgacaggtcaggagtttgaacagaggtgtgtagcaatgggggatggggaactggggatatccaccacaaagtcccagatgccaggaaagcaagaggctcccaggactctatggggatgaaattagatgaaatacccaacagaggggagagacaacctgtagagaacacatctgaggttaggcatggcccccatttaaggatgtggctacctacccatctcaaacattttaacctagattttctcttgtctaaaggaaatacagggacatagagtgaaacagagactgaaggaaagaccatccagagactgccacacttaggaatccatcccagatgcagtcttcaaactcagacactattgctaacatttcttttttgtttgttttgttttttgctttttgtgttttcaagacaggttttctctgtacagccctggctgtcctggaactcactttgtagaccatgctggccttgaactcagaaatccgcctgcctctgcctcctgagtgctgggattaaaggcgtgtgccaccacgcccagctcaacatttcttaactatgaaaaaaataacgtttttgttatgctcaacagcaggtggcagctgacaaagtataattgtatgtggtcctgaaacattgtaaataattttaatgttattataacattcaacaaaaacacccaaattatttttccttctacttaaatctcaaaattatgctaccatctctaatctcaacacaataagtgaattctgaagcaactaagctaggtggggcattattggttttagtttagaaagcacgcacagttagtctactgtagcagtgcccatttgtggaaatttctgctcctttcttcatagactcctgggtggaagaaaagtgagacctcaacaacagcacttcatctggaactcaacttccagaatggagattgaaaaatataaatcaccaaaaccaaaggggagttttatgtcagtgagtccatgagagtataaatgaccacaatgacttaagaaatcctcatagaaggtaggcaagatggtttggtatataaaggatacttgctgtcaaatctgatttccagccctggagaccaatgagtgaagaagagaaccctcttctaccagccagttgtcctctgacctctgcacaacacacacacacacagggggggggggggagggagagagagagggggagagggagagggagagggagagggagagggagagggagagggagagggagagggagagggagagggagagggagagggagagggagagggagagggagagggagagggagagggaagtgtaagaaattcaaaagacatccaaatgggttgccagaaaaaaatgcagttacgtttgtatttgtaataaacaacactatttttgtacttcagaataaatagcaggacatctagctatactgatagttaattattgtttattcgaaattcacttttacctggacagcttgctaatttctttgacaagtctggcacgcttacatctgaggaaagtctaccattctaaaatctctctgcaacttgcctgaaatccagttaactcactttagcccttcagcttaatataaattgccatttgaaatacacacatatgtctgaggcatacatgagctgctcatgcatcaccgtaaattaatttaaagaaatttaaaaagactgatgactgatttcttctcaatatctaattttttttttgttaaagaaaattcctgtgaagcagctgtatgtgcaaaggttgtgaggctgactaaaactttaaaaactgtggagggtaagggatgttgctgaaccaggaagcttacttcaagtttccttggagctatctttttttttttttttttttttttttggagagtagattcttaaaacatccttaccacaatatatcctcccttcactcttcccatctcctccctacatcttctcccctgcatatccactccccctgcatttcttcttcagaaaagaactggccttcaagagagtacagaagaatgggacaaagcaagatacaataagacaaggcaaaagcccgcctatggaggctggaaagggcagcccaataggaagaaaagatccccaagagcaggtgaaagagtcagaaacatacgcactcccaccattaggaggtaccacaaagacaccaaactcacagccataacacataagcagaggacccagtaaggacctacccaaatatcatgccattttagtctctctgagcccctgtgagccctgcttagttgactccatgagccaatgtttatcctctctgactcctaccatctttacccacttcttctagttctgaggggttctcctagctttgaagagagagatccaatggagacctccaatttaacctctctctcaacacaatgttttactctaggtctctgcacctactcctttggggccatttttctaccttaaggagacactccttgctcaactctatatcagtcctaacatgttgataagcagattttaaaaaaataaataaacaacaacaacaacaaaaaaaaccaaacaaaatcactaccactacaacagcaaaacctttgtaatgtattaacaaaattttattcccaactaacggaagagctcagtagttatcagataacatctgaggcctatctgcctggctgcagtctgcttctctgatatacccaccaatgaattttaaaattaccttgattcatgacttttacttttctgctattatagaacttggtgaaacagtatccacattggaacatggaattagggtaacttagtaccctgtttgtaagccatggccactcaaatttggctccaaagtaaacaatctcttattccctttgaatggtatattagttgcttttctgctgctgtgataaaacactgtgaccaaggagagttacagaaaagggagtttattctagtttatggttccagagaattagagtccaagatggtggaatgaaaacaagggagatgaagaagtaactgagcgctcacatcttgagcaacaagcaggaatgacaagcattttttgtttgcttgcttgcttttggcaaaacaaaacaaacaaataagaagctctcaaagcccagtcccaggaacatacttatccaggaaggccatacctcttatgactccccgaggtccccaagtggagactaatcgttcaaatgcttgaggttgggaagtgtatctcacccaaatcttcaaaaggtgggagctctattttttgtatcaatgtttgccatgactaattcgggtctgaggatataggagatttggtttggttggtctggttttgaaaggggaagaacacaggattgtctgtgaaatgttaattcaaactcattttaacggttctgttcttataggattatcatgtgtcagggaatgctacattgaaaacatgagtttggagaaatgaaatgagatgtaagttaaaagatgtaaagtaggggatatatagggcggcaagtgtgagagcaaatgtgtaacatgaggacaatagttaatggaatggtgtcatagtcaagattttataaagagtacttagctggccttgtcaaaaaaagtacctatataaactgatagacacatttatctgtttcatgacagtgaacaattttaccattctgtacgtatccaataagatcatattgatgctttaaatgtacacagtaggaactacttgccatcaaagaaagaacaataagtatgacatgatagagcataagaaagctctttgactccataatttaacttgaaatatgaagccctcagaagtagagctgttgtagattatgagaaatgttataacaggggcaattgattttcataaacgatggagaaagtataataacctagtaaacaggtataatttattccatagtttgatttttttctaagaggatgatttctcttagaataagttctctttggagaatgggcagttattattattgatgtaataaaaataaaattactctgtgtttctggaggagaagatgaagaagaaaagggtgaagaaagaggaggaaggggaaaaggaggaggaggaggaaggggatggggggatggttacaaggggcaaaatgttcacagtgagtttatgggtctgtgccttttttttttttttgtccacatggaagtcttgttgtccacgttggaaatgcagatttctctctgctccagacataatggagatgaatgcctataagtaagagctctgtcattaaacatggatcagacattccccaggcacaatctaatagaaaagaaaaacagaaaaacagaaaggagtcagaatagggggatcaatctgaagaagagtggagtgaaacggtttggaaatcgaaaaggcaacacaaagaataatgacaggtcagagaaggtgacaggcttaaaagatacaaccaaataattccattttcatgactccatggtgaagatgaaagaagcagaagccgtttcaaaagctaagccaggcaagagacttgggcactgaccccaaggacagtctcacagcactcacaggtttcaagtccatctcagttcttggtgagacagtggtcttccattgcacaggtctgtggcagtgaaaattcctatttagtcactctatgggaaccagagtgtaggctctgaaagatcttgaaagtctattgctaaaaattgagctaagaatggaaggctacgaatttgggaaggagaacttaggagagcacaacatgggaggagttagaaagatgagaaggaaggggaactatgcaaatgcagtattcacctacatcattttcaatgaataaattttatttatttatttacttatttgaagggattaaaaacaacaacagaatcctgagataaacagggaaagaaagcgcgggggaaaaaccataaccctgagagtctggatttggcctgccacagacctagagtagaagaggcccaggaaggacaagatgtcccatggagagcaggatgcccgctgctgataaactacaggttcagttggaagggagctcagtttaggcaggaagtaagtgcataaggaaagaaagccctaccattagtatctgggaatagttctcatcaactgagagcaaaccttgtatggagaactgagtctgaaatcagtgggtagatgagcagcatgaaccatttctttgcctgatggccacagagcctgagaactcaagttccagccatgaaatacagagctatattctactagtaggctcattgataaacttagaagttcttgcatgcatgaagacaggctctccatctatctagaaaatgtcttctatggtcacttagcacatgcccagtgcacttgggagatacctcacagctaagacattggctatctcaggggatgcaatctggattgtctcagtggggtgacagcattttcccagcacacagacttaaaacctgtgtactctgatatacaaagggaagccaccaatctgaaaacaactctggtaaccagcagagagtgtccaacagagcatcaggaaacttaaactacaggcaagacatcagcccacagtttaaagggctatgatccccaccatgtcatgtaactggtaatctccaattttctaggacctagaaggaatccattccagcacttcgcacacacaccccttctttttaactctggggattcttcactttccctcttgtcattgttaagctgttagaggcacttttattgtagtcttaaaatttgtcttttattctcatcatttaattatctcattttgtttatgcatatttttcattattgggtaatcttgatttttttttcctttttagagtgcttcttcttattccttatccttttagaagtattctgatcttaccttttattattttaactggaatttttaaaaaaaattttttttctaacttcttaccctgtcctattcttctttatgatattcatctccacttggttcgttttttcctctttaagtggtcttcacatctctactcccttttctgtctccttccttatctctttcacttactgcatccacatttacctcaactaaagagtatgactagatcttgaatggtttgatgttggtgctgttagagcagtttgctctctccactctaactggaactggtgaccaaactctccagagtaagctgcttagccccatgtggtggaacataactgtggttgtagaaccgagggggctgaggcaggagcttagccccgtgtggtggaacataactgtagttgtagaaccgagggggctgaggcaggaggatcgggctttcaggtcacactttgctacatagtaagtttgcagccagcctccttgtgagatgtctccaaacacacagaaacaaaagaggaaaaggagaaaaaaatgactgaggtattcaatatgaaatactcaaataaaacttcaagagatgggacaaaacccaaaggtataagaagtgtagcagagaaactcaagaatgtgtcaaaggaaacagtatttcccccaaaaggtcataattctcggcttctcaaaagacatggagatttgttaacatctagatgaagacttcacaagtttatttgatcaatgaattccgagaggatacaaacaagcagatgaattcactcttgtatttgcggaggaaagtcaacaacacagaagaatatgacagtgggactgatgagcaaaactctaaggtacacagaaaatgtcagcaacatgaaagaaagattcagaaggaaaattgagtttttaggggttttttttgtttttgtttttaaatgaagaaaccaaaagaaaacaaacaagccattggaaaaccacacgacaaatgatttaatgaaggagaagaaggaatattactgaaacaacaaaaacccactaagagaacagacaataacaaagcaattttacaccaactaaaaaaagaaacaagtaacaaaattataggaattagtaaacatctctcaagaagaataacattatatgtatatagccagaactcactaattaacacagattggccacctagatgcctgtatgaagacaaattaacaacaacaaccacaataaaaacattgaccctgttactatctccaaaaaccacaccttatgggtaaagtcagccactgttggagaatgagacaatctaacaagtgagtgaaatctgaaaagaatttagctgtcctacatttaataaggtagacattaaaacaaattagacagaagacataaagaaggccaagtgagcaatgaaagggacaactaattaagatggtatattaattgaggcaggcatggtgtcacacacctagcacacggtagacagaagaggccaatctctgtgattttgaggccagtctcattaatagttccaaaacagagctacatggaaagactgcctcaaaaaggaaaaagagatggaggaggagaaaaaggaggagaaggaggaggaaggagaagaagaagaagaaggagaaggaggagaagaaggagaagaaggagaagaggaggaggaggaggaggaggaggaggaggaggaaggggaagagacaaaacaaccgtagatacacatcaaattttagaattcttaatttcataaaacactaatggagacaaaatttcagatacactcaaataataatagttgataattacaatatcatacaataatttttagatgcattactcaagctgaaggtcaataaagaaatttaaaatataaataggacaaaatgacttaaaggatatatagagaatattcaatccaacatatgtgtttataaaagatacacattgttctcagccgcctatggaagcttcctttaataggtaacatgctacatggcaaagcaagtcttaaccaatataaaagaatcaaaataattccttacgtcacgtcagatcacagaggaggaaaatgagaaatcaacagtatgagaaactacagaaaatacagaaatacattatactcttttgtatgtgtgtggtatatatgtgtgcatatgttcaagtgtatgtgtgtgtacacttgcatgtggatgtgtaagtccattcatgtggaggctagaggtcaaagtatgtgtgccaggggctctttcttagtctcttgctcagtttttaagacaagtctcttactaaacctgtggcttgttgatttggctagattggacgggccagcacattcccagcatttccctttctctgcctctgcaaagcttcagttacaggcatgtgctgcccctttagccatattatttagtgctgtggatatgaacacaggttctcttgcctcttagactttattgacagcctctaaaaaggatacttttgaataacaagttggacagtgagggagtcagagaggaagcttaaaaatggctggaatcacaagtaaaaacacaccctaagagaatctttggaatagaaaaagcagttctagaaggaaagtttgtagctctgagtggttatattaaaaactcagaaagagctgggcatggtggcgcacggctttaatcccagcactcgggaggcagaggcaggcagatttctgagttcgaggccggcctggtctacaaagtgagttccaggacagccagggctatacagagaaaccctgtctcgaaaaaaccaaaaaaaccaaaaaaccaaaaaataaaaaaacaaaaacccaaagctcagaaagatttctccacagtgagtcacaactggctaaggtatagagatgaagaacctgcagaattctcagcccaaagggaacataattactgtaacccccacccctcaaggcttagggatgaacacagaagagtctgtggtggtggatgccgaccacacgaagcattatcatctgaacactgcagaggcgctacacataggaactcagttctttttcggcggagtatacaggtatatatactgtatatagccagaccaaatcccagcagggagaagggagttgggcacaatcctagccaaactctggagtgattgacaattgttagctgcgagtatagtgtaacctctccttaggtgagtactctccagtagaagacaacacatcaaaaggctttgcaaggctaaaaagacaatgggtacaaagttacatggataaagaagtggtgttgaacccttctcaatagtcacaaataatataaaatatcttggcatgactctaactaaggaagtgaaagatctgtgtgataagaacttcaagtctctgaagaaagaaattaaagatctcagaagatggaaagaactcccatgctcatggattggcaggatcaacattgtaaaaatggctatcttgccaaaagcaatctacaaattcaatgcaatccccatcaaaattccaactcaattcttcaacgaattagaaagagcaatctgcaagttcatctggaataacaaaaaacctaggatagcaaaaactcttcttaaggataaaagaacctctggtggaatcaccatgcctgacctaaagctttattacagcgaaattgtgataaaaaccgcatggtactggtatagtgacagacaagtagaccaatggaacagaattgaagacccagaaatgaacccacacacctatggtcacttgatcttcgacaagggagctaaaaccatctagtggaagaaagacagcattttcaacaaatggtgctggcacaatgggtggtaattatgtagaagaatgcgaattgatccattcctatttccttgtatgaaggtcaaatctaagtggatcaaggaactccacataaaaccagagacactgaaacttatagaggagaaagtggggaaaagcctcgaagatatgggcacaggagaaaaattcttgaatagaccagcaatggcttgtgctgtaagatcgagaattgacaaatgggacctcatgaaactgcaaagcttctgcaaggcaaaagacaccgtcaataagataaaaaggccaccaacagattgggaaatgatctttatctatcccaaattggataggggactaatatccaatatatataaagaactcaagaaggtggactccagaaaatcaaataaccccattaaaaatggggctcagagctaaacaaagaattctcacctgaggaataccaaatggctgagaaacacctgaaaaaatgttcagcatccttaatcatcagagaaatgcaaatcaaaacaaccctgagattccacttcacaccagtcagaatggctaagatcaaaaattcaggtgacagcagatgctggcgaggatgtggagaaagaggaacactccttcattgttggtgggattgcaagcttgtacaaccactctggaaatcagtctggcgattcctcagaaaattggacatagtactaccggaggatcccacaatacctctcctgggcatatatccagaagatgtcccaactggtaagaaggacacatgctccactatgttcatagcagccttatttataatagccagaagctggaaagaacccagatgcccctcaacagaggaatggatacagaaaatgtggtacatttacacaatggagtactactcagctattaaaaagaatgaattcataaaattcctaggcaaatggttggacctggagggcatcatcctgagtgaggtaacacaatcacaaaagaactcaaatgatatgtactcactgataagtggatattagcccagaaacttagtatacccgagatgtaagagacaatttgtaaaacacatgaaactgaagaagaacgaagaccaaagtgtggacactttgccccttcttagaattggaaacaatcacccatggaaggagttacagagacaaagtttggagctgagacaaaaggatggaccatctagagactgcatcatagagatgccagggatccatcccataattagcctccaaacgctgacaccattgcatacactagcaagagtttgctgaaaggatcctgatatagctgtctcttgtgagactaggccggggcctagcaaacacataagtggatgctcacagtcagctattggatggatcatagggcccccagtggaggaactagagaaagtatccaaggagctaaagagatctgcaaccctgtaggtgcaacaacattatgaactaaccagtaccccggagctcttgactctagctgcatatgaattaaaagatggcttagtaggccatcactggaaagagaggcccattggacattcaaactttatatgccccagtacaggggaacgccagggccaaaaagtgggaatgggtgggtaggggagtgagggggagggtatgggggatttttgggatagcattggaaatgtaattgaggaaaatacgtaataaaaataatgtaaaaaaaaaagaaatggtgttgacttacaaagagccaagagaggagtcaaatatggtcaaaccacattattttgcagttctcaaagaagtaataaaaaaaatcgaacacatttcctaatattgtacatcaagcacttacaaaagtaagaacaaatcatatgccctaacaagaaacaataataatcagtgtgaaaattagagagaagcttaaaagcaatacataaaattaataaaacactgggataatcctttttaaaattaaaattgacaaagataaagaaagagaagattcagattagcaaaattataaatgaaaaagggaaggccatttcagtttctaacacaatttaaagaagcattagagaatattttaaaaagctgtactctgaaacctggcttctaattttagcagaaacctcacatagggtctccaaagccaactctgagcctggttggtaaagctttctgtccttgctagtcagtttcttatcattaagcaatctgggattcaaagactttagcagtgaatatttccacttcagtggttgtcttagtcactgttctattgctgtgaagagacaccatgatcaaggcaactcttataaaaggaagcttttaattgggggcttgcttacagtttcagagtcccttatcatcatggcagggagcctagcagcaggcagacaggcaaggcactgaagtggtagctgagagctacatcctgatttacaagctggagtcagagggagaaaagaaagaggggaagggagcaagggagggagagagagagacagagagagacagagagacagagagagacagatatatatatatatatatatatatatatatatatatatatatatatatatagagagagagagagagagagagagagagagaaagagagagacagacagacagacagacagacagagaatgagagttttgaaacctcaaatctcagccccagatcacaaatcctacaacaaggccacacctcctaatccttcccagtagtctaccaactggaaaccaagcttacgaacctctgggaccattctcattccaatccccacaaagggcttccaccttgttaattttactatcaacgaaattgacttttgactttgacaattgattttgtatacaaagaaactctagaaaagaaagaaaacgttaagtcataccactaaggatcaggaggcagccctggacagccgccacagcagaaaggctggcccttctatgtttctgtgaatcatagcatatgcgcttgtaagaagtgaaggatatttctccattcaattttatacatgacaaaaaatattcctaccaaatgtgaagtggcaagtatgaatttagtgtttagttctccttaaacagtcaccagaccttgaggtcttcctcaggttaccacagcttgtagcattcattaagcagaatggaggaattttattataaaatgtaactaatgtattatatgttattatcattacaaacccttgtatgtaacccagagagggaatacacactatggatctgctccaactttttaataagtaaattttagttaaagtctatttaaagcaaactcctaagacattaaccagctcccaagagctgactactacatgttatgttagcttgtccatggtgctatttgttactcttacaggatttctctgtgtagccctggctgtcctggaactcactctgtagaccaggctggcctcgaactcagaaattcgcctgcctctgcttcctaagtgctgggattaaaggcgtgcatcaccacgcccagctactatttgttattcttaaatagctaaccacagcataaaattttattttcctaaaatttacatttaaaagccatccaacttaccaaagtgatttcaaaccacaattacattttatctcaactaccagcattttatttagccaggatctacatgagacacatatcatgatgtgctatgtacatcttgttatacagtgttatattgataacaaatgtcatcaatataacattgaattaatcttccataatttatggggaaaaaaggagcagccttactgaagggcaaagttatacaacagctttacagaagctgcatgcgagtgcagtaccgggacacgggcacggacggcggcactataaccattttccgtggtggtaatcttgctttcatctgacacagaaaagagaccgccgttttgaaaactcacagaactagcctcacggttttgtgagtccattgagcgctggctgcgaagaacggtgtttaactcgagaaatcattgaacaagttttagaaaataaagatgcttatgacaatttcaaacttgaaggtctccaaagaaggactgagatattggtgagaggagtaaagagaatcctggtgcatttatttcatgcttccttctgttcgaagatcattttgaggtttataaaaggtggggtgatccaaaaatctccaggctgagagtcctggctgaggctgtgaactgggctgcagagaaagggccacgcctccctcctctgctcgcattactcagcagcttttctgcatgtggctggctgcagacaatctaaacccttccgctgtcgctccccccttatactgttctgccaaaaggaaggcagagaggaaatcagctacggggcaaagactgaatagtgaacacatacagcaatgtccagcgagttacctcctgtgtcttatttatttatttatttatttatttatttatttatttattttctctaccgattcgctaaaatcataaagagaatgcttctgtctgacatcttggaccaaaatgcttcccatactgcactctgtaacttttcaattgaatattaataactaaatggatttataatccattatttccctttggtcacctactcatcacggactaaacgaaagggcaatgccattatcttcctggcccaactcttaacatacgtgtcattgccaaatcaaaggaaaccttaccactgagcaattcacagaacttcgcttagctaatatgcttaaggaatctgagaatgtcctactaaattttaattgaatgaagaccttttagaagaatttcttctgtagataaataaacctagagctaagaaaggaaagctacatctacaggctccatctcaaagctatctatatctgtagtcagttttcagggttcctacatagagaataagtatgtgttgaaaaaatactacactagtaagcagcctttacatcagtggttctcaccctgtaggtggaaatccttttgggattagaatgacagttttacagaggtcacctaagactatgaaaaacatagatacttacactatgattcataatagtagcaaaattacaattattaagtagcaatagaaagaattttagagttgggagtcatcgccacatgaggaactgtgctaaggggttgcagcatttggcaggctgagaaccactgctttatactaccaaaattttggaagaaagggagtgagttcattcatggccaagtacaattgctaaagatggagccaagattaaactgatctaagcaagagaaggaagtatttctgtcttggagtcttagcttctcagtcatggacattccttgatggtatctttccacttagaatatttagggttctgaaccctatttctgaatgcgatttcttgacttttcttggcttcaattccatcacttctgaagtctataaatactagagccctatatagccctctactcctttaaaatactgtcctcaatggtcgcttgcacacagaaaactctacataggccacgtgactcttagcttagttagctgagaaaatcaggaactctttctgagcaacactaaattgggctgagaatgagtcagaaaagtcaaggaaacatgaactcaaagtcatctagagttgaattctgggaagtgaagcttagagcaagcaaaggaccataacaacaaaagagaggcctaaataaatagatagataggtagataggtagatagatagatagatagatagatagatagatagatagatagatagatagatagatagatagatagataaagcaaagcaattgtcgagtcaccaggataaagaataggttcatctgcttatgtggccaaattctcaggggcacttctgcctctgccttagtcgtatttcggctcttggctctctgattgtatgcccactattaatgcaccaattacttatattaagttgaaataagctcttaatataagtcttctgtggcccaaacataatgtgaaaatcattttcatgtcacactttaattactcataattctatctttgtttctttttatttgtgagacacagtcttgctctgtaacctaacggcctgtaatccactttatagtctaacctggtcttttatcaccctgcctcattttcctggtgctgggattacaggcatgagtcacaaagctgggtagattcttcaggggtttttttttttttctttgtattttttaatttattttctggcaatctcactcgtgtccattatgtgtgttgatcattttttatcatcctgttcgcccacacccaatgaacttcttattcctaatacattctttcctagtttcatgtctctttgttggaaggtcacagactgagtgtaattaaagctgtttccatgaacacggcattttgtggaggatggttactggagcatggacaactgacaagtggcttcagcattgaatgaaatacctgctttaccacagtggcacttaagtgcatgctgatggcccccttgggtgagggtggacctcctaccatatgtcattaaatatcatgggctccatcttgtgtaactaaccatagccattgtgacttggctatagcagagtcatatccaggaaacaaggttttcagaactccttttatgttatttctttcctaggagtcgttgctcatagaggccccagtggcaggcccataaaacagtaggagctatagccatcgcctttgcttgctcattagaagtggatgataggaccctgttgctgaagagattgcagtcttcggttacagaaaatagagaaatcgaggcgggactgacctagaagcttcctcccttttgcttagcatttatagtcccagaaagtgcttttgtaagctgctagtgaagaaagtgatcaatggcctaaatcacttgtgaccaacctaccaggacaatgtacctactggtgcaataatcacagggctgattattatgagggtaaccaactggtctttgattgtatctgaagcctgcttcacaagatggattcatgcctatcactgttaagactggtcctaagcctatggccagggaattcataggtactaatgagggagttagaactgttgctttgctaaatgccatgctgtcaaattacttcccaaatacgtttgtttatgcccatagatagtgctgctctcaacctcggctagagaatcttcatcttgtaatgggcaaaggttaatatggtcactcataaataaccatttcttttagagtaaatgactttgagtgctcacccctaaatgaatcatctctaccactttctgagtggctcatggaacatggtagaaggatttctatgtttttactatagagaataataaaaaagttcaacaaaatgaaatattataaatacttgagtgatttgccctatggtataataatttttcaatacttgttttaagtctggaaagtgctcttctactgatttaaattactgttttaagtactgaaactaaataatggcacatacatatggatgacatgtggaaacaatttgcatactgagtaaaaatattaataaaataacataaagtggaaaatcactcatcttttaaaactggggatattgctaaatatagattgtgtgtttaggaagcccagagctgtgggcctgatccttagagccacattataaataaagttaaagtaaaaaaacaaaacctagacattcagtagggagatgttttaaaaccttggtgaccttgtaggtatctttcaaaaattgtatcatcccaattattcatattaagaatattttttaaagtgccacaggtaaaaaatcttttcttaaaaaaagcctttaacataatctctagaatttggatcaacaacattgctgagatattaaagtttcatggtacaaattatgacagaaaagtttgaccaaaaataaagcagccattgttgctacagtttaagtgtaagaatacaatagaatgggtcttggagagtgactgaattttacagttttataatcttttctaatgaagtacacaccttgtaatcattcaataatttgaacagttcataatattgtttaaccaatttagactgcaaagacctcggtctgacagagcaagtcttgacctgcttaacattatgttatgctagtcattttaaaatgagtctttatttcccatagaaggtcagtttttttacattattatataatcttttgacagaataacaaataacattctgaatgtctcatttctaaatacaaaacatcttagtataaaattatgcattgttttaaatgcttggaagtaggtccacatgtagaaaacaaagtacgtatgataaaaaatatcaaaattgtatattcagcaggcatattattagaaattgtaccacccggtgatttattagttactaggaaaactgtagagctaaaccaaaaagtaatcattaaataacaatcaatgagtcaaccaattgttaaagaaccaaatctataggcacatatatattacaaggcatggggtaaacagagatttgcagtgtgctctccttcagttatgaactgtactgcataggctgagggatcaatctatggcatgccatgcctcttcactttccccatcagctgtaaggaagcacaaaggcgaatccgggccagcaaagaataatgcttgagcatttgacatttcaccacttcctgtagcttgcatgcgttttattacactctttgacacaatatttgattttacaagttggatcaagttgtttagtcagcaaaacaggaataagcaaatgagattctacctgcctacaatttccgttcatctccagccgtctgtctgtccaccggaatgaaaactggagcatactcacatcacaaggggcacatgcatcagcgtgaatgaagctaccatacctccctttggtttcctcatctccaaaatggaatctccttttcagtattttatctttactgatttatcataagagctgtatgattcttaccttttttgtttacttagcagagacatcagaatagtagaaggaagatgaacaatgagataatgctgattttgtatacaaagtacaactcttagtaaaaaatgttgttgctttcagtggtataacaatgttattaaagtttttaatccatgtctggcttttttgttgttgtttacttttatctgtctggggagtcttgctatgtgacagacttgtttagatctgactatgtgtccagtctggcactgaactgaacagtgattcccttggtcctcttacctcgaaccctaagtagtcagagtttacatttgaggcaccataccaggatttgcgtttgacttcatacacataactttaacattttaagatggggaaatgcaacaaaatatgttcttttcataagaagagagtttatagctctcctattcctgtcattaaatggaaataatgttttgttgatgatttattaagcaaacacgattgatggttccttcaagtttgtgactggcgtctcaactgtgttattatttgtagtagttcttgaattaaagtgtatcagtctacggatgacattccaatcttccctacctcgatggaccagtttataaatttgaaggctgatctgtttcatgttcctacttttccctgaaagtattcatacctttttacgacataccacttacgcatttgcttttcatttcaacattctgactaatggtacttattaaacagctacagtctggttcaattcctgaagatgttagtacatcgcccctggatctcatagagttgttactaaccaagtagaacctcacagatacgcctgggacagtcctaacacagagaccaatagttatagaaaatcaaactcaggtttgtcacgagggctctaagaatctttattgtaccctccagctttggttcattgctaatacatgctttataggcaaccataactccctaaagaaacatacatagagtggtatccaataaaattaaagtttttcaaagaggtcctttcctcaccaaagcctgtggacagccagtgtgcatggctaccatcagtcgccactgatgattccccttgtctcatggagcattctcccctggtttctgatgaaaaagttgcgaatgggtgagagaccatgcctcttaaaagcataggtagatatatgatagctgatcaatagataagtagatgatatattgatagacaacagccttcctaaagtgtggctaagcactatttattacttctgtcttggtccacatgtttatttactttatctcacaaggaaatgaaattgatccgacaccacctccactcacaagttatcctggcttttactctgtgctgttctggatgactgtcaatgtaaatacatgaggtttgtgttgattttgttttgtttttgtttttttttttctttagaagaaattttaagatattggatgaagatgaaagtcgtaaggctatttaacctcttttctcaaggagaatattccaaattttccttttcctagagttagatattaacttttaaaaattccattaaccatttagatataaatctcaacatcttacattcattttatatatttttaaaaatcggcaaatgaatgacaattacattttgcttgtattttaaaattcttctgtctacttttggcctagaagaaaatgccagcttttagaaatcttttgtatcacatccattaatccctgttaacttgctccctctaaatactagtgtttgtaaaccttttcaggtatctccagatagctggtctaaacaggaatcgtttaaaacctttcatatgtaagattatcatattatcctcaattggaaatacagactgtaaaaactatttaagatatacaaagcccttacattcagttcttgattttaagtagtcttttagagtaccagtagattagaaaatacttattgctaatgaagtgctctgtagaaatatttgtgttcaattcacattatttacattgcttttctctcaactgttttttattataatttatgatgtgaatgatagtgtattcacatgtacatatatgtttattaggggtagggtagagttaccatcaaggtagagaataacatcttttcagttagtgatttagtacttgtaaaacttcgtattcaataaaactgcattaatcactatcattattagtctataagcttatttatatattttactcttgaaaccatttactagcaaactacttttccattatacattttaagaagttgacattttagcagtgctatcatttttttactcataaaataaaaagcaggatgtaataatgtcaaaaattggaatgactgtatgcctaaatgtcactcagcatggataaccattaaattgacacacccatctacctaagaaagtattgaggtgattaaaccaataacatgaaaatattgacactttaaatgtagaacatacggaaaaatgatgttactgagtcaatgcatatttataatgaaggatttcacttaagactgaagagttgcattacactctgcaatatatttgttgatttaaagataaattattaagattaaatataacaatttatgtaattccaaatattttatcattcatagtaaaagatactttttagtatccagaagccattgaattgtagagacatgttttgtttgttaagtccgagcaaaattatttgataacgtaccattttaaatatatattgtgcccatagaaattaggcactgagaaagtaatactcaacgaatgaaatttcagtgatttttttttttagagctatctattttgtaggccatgcagggcttgtatacatggcctggtttaataatattaaaaaaatgaagcagtttgaagaactgcttaccatgttgggttgggatacgtaagagtctatgtgagtgtgtgagtgagcgtatgtgtgtgtgtgtgtatgtatgtgaaacacacaacttctgctttgaagaaagacacggtctattaggagagacacactggacattatttgcgatggttgattttaatgtcaacttgccacaaattcacatcctctgagtgggaagcaccaactgaagaatggtcctggtcaccttaattgatgtggggaaacccaccccgggtgtgggtagcagattctggtagccatctagataaagagagacttagtggaaggaagcttattcacagcttgctgacctttcctcttgctgttgagtttactgaccatctggtttctgcagctgactcctttattgatgatcaggaccagtggtacccaaatacctagcttccaccatcgactaaggtctaggtaccttccagataccttccatgttttggccactatatggagactgctgaggcacccagccttgtggatggagcaactactgcattgccagccttcccagtgtgagacagccactgtggaagtaatgtgattgctaaagtagccttaagaaccaagcaataacaggttctgaggctctctggtgtgagctagttgttatttctattttaatataaactgtataaactgagtaaattatacacacacacacacacacacacacacaggcttttgaaacacagaaatacagatgaggatgtgattaatgattaattcctccaggacactgggagaggaaaatgttgctaagaagcttcctcggtaggcttgaactcaagggcaagacagtatactaggaagcaaaggaaagggctgtgggtataggaggcatgtaaaattaatataatgttttgatatttaggagaaaattgcaaaacaaaatgatgacagtgtttgaaagtgtttgatcagtgccaagcatcactttatgtacttggcaaacatgacttgaggccttaagctgtgatttgcaaatgtagattggaatcaagatctttatagatgaggaagcaaaaatcagaagacaaaataacattatcaacttgatctcatgtgcagccagggctgaactgcaaatgctgatttgccccagtctgggctcctcaaatcgttccttggaatcctattagttggaactttatctctgctcgtggcagggtgcctgggaccatgtttataaatatctgctgaatgaagaataagtgagtcaatcgaaccagaactcactttggttagttaatttcattcgtggtatttatggagagcagaagaaagaattccagagacacgatttgtcaaaactctctaaagaaaatgatgacactatatattgatgaaaatgaatgttcttgttcttgctttatttgattttcttgtccccccactccccatctgctagggtctcattacagcatagttcttgaatatcccaggttgacctgaagttacaatatattcttgatttagatggcagacattgggaatattttgactcttaaaatttaatagctaatctttgaagaaaattaaaatagtgatctccattttgtagacaagaaagacaaggaagagagaattttacaaagagatagcgaacaccatataacgtcatagcataatctagtttgggaagaacggagggccctgaagcaccatggtgtttgccagtaatcactgtattggatgtgtcatgctgaaatgcaatacaattaggctggcataaaagctaacttcacatgaagaaatagagactttgagaaatctcttctgaagaagcttgtctatgtgtagaaggatgagacgttattgagcccagtgggaggctttatcaggaaggggtagatgtcttatatactggagaaaaaaaatgctgtaaaactaatcaaaatcctggaatagagagtggacatgaagactggggtacagggagcccatgaggaagaaggagctgcttcaaaactcaaagacatggtgttctaccttcctacaacgtgtcttcatctgtaaatcagggtttaaatttgataaggcagaaaacagtcacaagactatggtctgcgtccatccaatcagctttaaggttcaattcagccctatatcttttctatatctgatcatttcccttcaaggtattcccacttaaaagcagagtagggtacatattatcaatggatttatgattcttggtcaacagttcaacagaggtttctttctttatctctttgttcttttgtttttttctttgtttctttctgtctttgtctgtctgtcttctcttcctccttccctcttttccttccttccttccttccttccttccttccttccttccttccttccttccttccttccttccccccttcccttcccccttcccttccccttcccttcccccttcccttcccccttcccttcccccttcccttcccccttcccttcccccttcccttcccttcccccttcccccttcctccttcccttcccttcccttcccttcccttcccttcccttcccttcccttcccttcccttcccttcccttcccttccctccctccttccttccttctttctttctcattaaggtttgaaataaattggccacttagtcttgcctctgtagataaggaagcacagtgctgcttgtgtgcaggtaaacaataacaccagcaccctgaaaaagtatttcccaaggaataaaaacaactccaaagactttatctgtgggagagtaattctgatagaaaattagataatttctcagcttatgtgtgatgttttaaaagacctcaagttaagtcctaagagaaacagtttttatcttatgcccaactcacatggaaatgcccttagcaatggtatttatagtatccaaaatgtacaattcacaaatgtatcatcaatagatggtgacggttaaacaagatgacacttagactagagaatgagtggaaaataatgtatgtgacacaagttggataaatctcaaaaacattttaggtagaataatggattatacaataggacataatgaatagttctgttatgaaatgtctagagacagcaaatgttcaggggcagaaggtaaaaatccagattgccttggattgaatggaagtcgatatttggtatttttgatacttgatgtacatgttttaaaatgattgcaatgatgtttttacaactctaattgtatttaaaagcactgaactacaaaaagataataaaatgattcttacatatcttcaaaatttcattcatttctctttttatgaatttaattatattattactggtgtgtgtgtatatgtgtgtgtgtgtgtgttacacatatgtgtgaactatggtgcactcatgccatgatgtatgtttgtaaaaggcagaggacaactttcagagatggcctctcagatccttgcagtataggttccattgacttcactcaaggtgttaggattgcatagcagtggttgctcagccatccttctggtattctttcttgttttagaattgtaatgtcttaattatttttctactcagttacattagttaacagcaaataagagaatgaatgatgaggaaattatttattactatgccaaacttcctgtttcacttggagccccaatattatgaatactattacagtggcctaaagagtgttattggttcagtgtcttaactgatttgttaaaatgactactttaaatgtgaatcatagatataatgctaaatataattttagaagaggcctctataatatgacatataagacagtcaactgttcttttgactaggagtcctcaacttcaaatcgcacaagctaagaaagtgcagaagatgaggattccagtgagctgacggggtggttcaatactttttccaaggatttacactctgtggttccatcagcaccaatgttagctgaccaggatggctgcggctcaagagtgtgacatctagagaggctgcagcagtaataaggaagacctttatttccccttgtggcgtttgcccaggtgagaagtgttcttccagaagcctgactgcagattgccctcatatttcattaatgaggtcaggagcccaacacttattcaatccctggcaagagcaatgaactcgcaaacaagccctcccctggaatttttatgaaattaaccaatttcctaggtcttctggatatataacccagaggggagagccatacagaattacagtcctactttagacagatgctatctattctattactaatgtaggaaagaaaggcaaggtcacttaaatgtccctgaactcaccactaatcaaggtcatacagatgaacttgaacatagcattattttttaaaagccatgaaatttaagattatctctaacttagagttacatattataattatatttaataaaatatatatcattgacggtggatataaaggactaccgtttcatttaaactaataattatagtaatttttaatattacagagttgccagctctaaatgggatgtgtccttggagctcagagaaccctttggaagaggaggtagaaagggtgtaagagtcaggaatggagatcagcaggagaacacagctctgtgaatcaactcagcaaagctcatacaaactcatagagactgaagcagcaagcacagggtgtgcatgggtgtataccaggtcctctgtgtgtatatatatgtgtgtgtgtgtattatatatatgtgtatatatgatatatatgtgtgtgtaatatatactatatatacacatatatatcacagctttcagtttagtatttctatgggactcctgcgtgtgaatgagtggacctctgattcttaaacctactcttgtggctttttatcttctgtttgtttgccttgtccagttttgacgtgatgatttttatttcatcatattgtatgttttattttgttatgccttagaagcctgttcttttctaatgacaggcagaaacggaatggatccagattgaagtggagaggaactgggatgcggaaagaaagaatctgtttataataaaagagaaaatactacgttagtctgctttaatatacaatgtggttcttagatcgcaagaaaaatattaatggcacttttgccttaggggagagcaaactttcaacaatacatatttgaagaataaataacaatttgggaaacgctttactatccctcttctgaatctaatattatgcaatatgttatgaaagagaaattctaatggatattttaaatcccttaaaaatgttcagctgaagagtccagtgttagttgctgctagaaaaaaagttaaaaacatgagaaatcaattagacactgtaattctacaggttattactgatgatgtaaaaatcattttgtctctcttcttgaaagttgaaaaggtgaagtagtttaatgaactataacatatgttttggataaatggtggcagagtgaaagaaagtgtcaggcaagtcctatgtgtgcttttcagccaaggagaaccaagcacaagagaggggtggagaatggtcttaaccccagtctacgcccaagcccttctcgttttatcttgtagatgctaaaaagatgttgttggagttccgttgtctcagcaaaagcacagatttggagttgtatttcatatttctttaaaaaatatttatgaatgtagtgttctgcctgaatgtatacctgcaggccagaaggcacatcagatctcattatagacagttgtgagccaccatgtggttgctgggaattgagggaattgaactcctgatctctggaagagcagtcactgcttttaatcaccaagccttctatccagcccatgtttgatatttttaaagtaattgacattttaaactttctctcaaaagtcatgatctgacaaattttccatgacgataggagtgattttataaatttaaaactattagtaaaaatgttttaacattatattattttttctgatggcactaaaaatatttgaatatatggcacatggcatatattgaaaacatcataaaatcctattacacaaaaggaataatgtagagtaaaatactaaatattaagcaatacccatgattaatatggagaataagaaattatgagatcatgaatattattttcttctttatgcatttacaaatgctctgtttttataatagcattataagtagtaaatttataactatgaaaataattgggttattaagagttggctccaagccaacatcaatggatgtctgaaaaatgtaaaagaagaaattaaaattttgagatagtgaattaagtcataagagctgcagattgtcacttgagaaaaatgtcagaataaattagaagaaagatatactgatgggagtgtatctgagtgatataatcagaatctgtgtgaaataatataaaattattatatgcttttcaggtatattttatataatggtatttataaaacatccttaaattatagatttagtaaatatgtaagaataatgtaaaacttcttattttggtttcatttaacttacttctgttgggcaattactgaacatacaaagttgaaacagacagtggtgacagtaccttgtcacacacaagatactaactacatcacactgcaaagaaggtatggagggaaagacaagcagacaccacacagtgcatacagttggtgctgtgatggaagtccacactgggcctaggcacatctcagaaggaaagtgactcctactgaggggaaggagaggtcatgatgtcacagagaatgaacaagtttcgaaggcttggaagcagcttcaataactcacagacacatttacttctacaggatagataggccacagggtaagaggtaaacctagacagctcatggaagccagtcatcttgcattggatttttaaaccctgacgccacatttaaataatggaagatttttgttgctgttgctgttgttgccattggtggtgtttgctttgagatagcatatcactttttagcccaggatggcctcaaaattcatagtgatcttcttgctgaaggtgttctagcaggctctggcatggcaaacagtacacacaggtttgcactttcacatcttttcttctccctttccccaaggtctattccctcatttggctactgattcattcctgagatgaaacaccgagggccaactataagaattaattatttggctaatatgtccagtcaggatttactaattcactccagcacatatttccccctttcccctttaaaagctcaatcatgaagaagcatccccttgcttcttttgccccttgctctctgatttcttttgctttcttacttgctgctatgttgccttagcagcagcttgaccatctcccttcccccgcagccccacattgcccccacctgctcctcctagttaataattcggtgtactgagaatttggtttaagagtgccgacctccctttcagtgatgctatgacttggatcaggactcgtttctaggacccccgatccagttctcctaatggccattcatttcatctcacagcagcttattggtgaggtttctcttactacccatcctaaaccttccccgaatcatcggatgattactgttgaatgtctagcatccctgctctgtcttgcgcaggtggggagaatgcatctccccacataccccagccttcagtggccaaggtggacttccttggatggtcttcaggcacatcccatttcattcagcttggtttggatggcagttgtctttttcacttttggttgctatccgtttctaaccatctgaaaattctatcgacaagctccagatttctcctcagtccactgtgccttccccttggtgatggagcttgggtgacgacccctcctcactgaggctcttatgagccaggagatatcttcagctctccactctggctcaaggccaccactagcaaaggaaactgactctctctgtactgactgaaaactccagcacacacctaaagttactgatgcatcccaccactcaaagaacggcccttctattccctataagaataaacaaaatgacaatatttacagagttggagtattccaggcatgtcccatcacactaggctcgacagcctaagtaaaatgtgcatgttagcgctgatgggaacatagaggtcagctgctcactgagaaacaggagaaaggagatgagttagatcaatagaaaatgcttacattcattccagtaaggaatgataaaagtttaaatgaacattcacaatttgctgacttacttcacaacacgtttactaaagcttagcaaagtgataatatgcacagatccttttattgtagcaggaaactttaaaactaatataatgcgataaatattttatccgtgtagcataaattaaagggactcaattgcctgcatcttaatctcgattagtgcctgttaatagcaaaacacacacaattaattgtactttaaaagcagatcagttatcaaactcagccttagaataaaaattttgatcttcaaatttgtttatgtagttaatatcattattgttagttttggtgccagggatataacccaggggtacacagtatgtgctaagcaatggcttagcccctagcatgtacatttttactatggttgaggaaccattaaagctttagcatcaatgaattaaatgcattgctattagaaattagagaaatcttaaagcattaaatatcaaaattgtgtgaacatcaatcataaacaaatgctaactaagttactttttaatggaaaatgaccatgtttctagagaaaaggacttacgtggcatgggtttttataattttataaattttcaaatatctaacctaatatctagattcttttacatttaacagattttaatttatatttagatggagaatatgaaaaacagttggtcttgcagaaaggtgtgtggaaacctgaaatagcgatttcatgtaagtataaatatttctccttcctggtaggccacattagataaataggtcagagtcatatccgcaaacccactgtactctgacctatgcaattcattggcttattgtgcacagttaggtgatttactatccacaaagatatatgtcataagcatggcccatttatagattgttagctgactgtgctatataaagtttaaatttttacagcctctcctcattagtctgtcaacatcactgctagtcacatctggaaatccttcatatttaaaatgctgctcaattcctggtggcagaaaagtgttccagtattctaatggtcatttttgtcacgggcaatacatatttacaattactttttactccttgacatggctcgatcacttctctcatttttgaaaatgacttaaaatgtaagctggaatggtctgcacctgtctacctgctacattttccaaggcgtgatagtgttcaatggaaatggaatcagtccagctggtaactcacacagctgtgcaggtgtgttttggggatgatattggggcaccaaacaaacaaaaaaacgaacaaacaagatgagccctggggctccagatgaaatagttttgcagcatcatcaaacagactcctttaagggaattggattttcattttatagattattatttttcctaggagcaaatggctgtgaaaaatttaacaattcttcataccactgccttactaaggattaacattgagaaatataaattgtttttgtaaatataaataaccatcaacagtgaaaggaaggaagagtgcttttatatgactataaagacagttgggatatgatggatgcctaaacgttttcaaggaaatgcaccaaagttatggggtaagataaaaaataactgcaaaagttatttttaagactgttctagtcttgatggggtggacacatttttgagagcatcaaagactaaacactgagttgataacatgactgaatgttttttgttttttgttttttgtttttgtttttgttttaaataaatgtcacaatatggcgacaagattaaaagtgaagagtatgcgagagtagagagtcaacaaagtcatagtgacaaaggagaggtggctaattggtgagcaggtaaggtttctctctggaggagaagctgctggagtttgtcactttgttactctacagtgttgcctggagttcgatacttcattactctatagtggggtgaagaagttcaccttcttattttcatttccttccctcaatgatttcttcagagctagctcttaccagctagaaattcttcaaacgacactcgtgccttccttcacacaggttgaactatttgtctctaatgccctaaagtactggtgttcaatcttccaggcacttccaatgatctgaaatctgacctgcttaggtcagctggctctgagattatggtattctagtcctcaaaccaacctgttggctcgttggttttgtaccaaacacactgacttacatagctcaaaataccactggccttttaaaaatggcatatcacattccaggggaggatcaaaactgctggctggtgatatttgtcaagtctctcaaagttgcactttccaggattttcaattcactgaattcttagacagacatgtttatgtgaaagaattctttatatattttttctcctctttgagtgggcaaatgaaaatcttgacctctgggttccttattttatttgactctctgtagtatttaaatcttaaaattttccttaaaataatctaagtatggatattaatccatgatattaacgatcgatccttgtttacagggtgcctttccctgctcctaccaggcgatttcatattttcaaggatcagttcttgaaagaggatgtagccctcgctctgccaatggctctggctcagcctcatgcatctgcctttgctatagtctcaccggaacattgacatagattgattttgccaatgtgatcagttgagttctacacagtttaaaaatgtcatgttctggcttagtgtttagtggtgttctttgttcatttatcgtttactatctttagtttttttagtgtatactcattttttcccctactaaaacccatagccaataatagacattccataagtacaagtaaatttcctgaaaattttctgaagtctgactggagacattaggttacaaaattacacaatttcaagtttcttatatcaaatctaatcttgtatcacatttctttccaaaatttccatttttacaattttgctaaaacagcaaattaatatattaaatatggactaatttaattaatattctaggtgataaaatattaaaatatttggctattttctcatttatctcctggtcactattttgattatgtaatgcttatccttataaattgatttgccaagttccatttgataaataatgtgttctaacatctatatttaattttttaatgttaaggattaagtttggggtctcacacatactggacaagtgctctaccattgaacctattttaacttttaaaacagtgtgttcttatttcaaaaatattttctgccattacaaactaaagaatttagaaacaaatcaataaaatgggaaaaactgcacaactaaattgttagtactaatgcttattgtgcaatgttttaaagttatgttatttccttatggtttttattttagatctacataatgaacattctctactttattaaaaggagaaaaataattctgactttaaacaaattataacaagaaaatagaaattataattgcatatagcagactctaccaattctaacactagttttattcattttttttttaggggaaacaaacatttgtatctttttgggatttgtgctattgtatcctcagcaactttgtacagaattaaatgttatttgatatgttacattcaatggccctgtaatatctttttgtttacatagattatgatttaacatagtatatgtaaactgttttaagtttcatcgggttgcaatgttttttcctacataggaatcttttggtagaagtgacagttgaaggtccagattattattaattaaaatgattggatggatagtccaaacttatcagccagacgctgatttgttagaactgtaattccaaatctgtaccacaaacagcaagagagaacagttagctggtttgttttaggagattacagcatcggaagtccaaccttgggccaactacttttactgcttgcttcattcctgccattttctggtgcaaatgttgggctctaggctgcaacattttcccaagacattgcactttgtttaaatgagcctgacccagtttctattgcttatagaaacactttggaattgatcgttttatttataaaattgtccataagctcctaagttttgcatccatcttggttcctcttgtaattaaaatgagtaaaagccttaatgcttagcacagatggtggctctaaatatgcattcacttctccacatcatgttatttatgctgcttctttaaatataatggtaattagctaattacaacattagcatatcaacatatgcccacactactccttattgtgggagaagggtatggatgacgaaaatccatccttaatacaattttaatcatgtcatcagcaacaaaaaaagactgaattgatattcagtcttccttgtgtattttagtcatcataagcaagccaaaggcaaccatcacaagatgaatcgtgttcacctctaggttcatttgcctaaagccaaacttccctactccatatctgtgtgtatttggaggcaaggcctttaaaatagttggatcacacggttagacacaatctaacttttctccatctaagtggaaatttaggcatcaaagcaagcactgtgaattcaggatcacagaagaaacaaacatgtcagagcacagagcatgaaaccagcaagccaagcagagaagcatcacaaggaaccatacctgtcaatatctcaaagcctgatctcatgcaaactatattcctatagtttaaaccacccagcattcagtgtagtgttacataggcccaaagcatctaaaataaaaccaactctatttgagaagtataattacaagtacaacagaacccctaatggcatttgagagacaaaggtgactaagcagcgtctaatgaagggcatgagcatcacttacatgtgtgcagcagaggacgtgcaatgcaggagggacccttctgggaaataactagccatctcctctcaggaagattaggttcattaaaatgctgtacctaattatcacttttgctttctgggagtatcataaacaaatgctttcccaaggagaaggaaaaatttatggtacacttgaacccaaaggttgcaatgggagaatatgggtcatttaaaaaaacccaacagatttaaatctatgtaaggttttccaagaaggtacttttttggtggcatttcctttaaaaggtgtcttgtatatctagtgtaaaataaatgatagtaatagcacaaatgaatcaccggccgtgttgctaagaaagttcaacttggatagagaatgcagtcttttcaagaaagagttctggactaagtagatgcttacaagtcaaagcaaggagcatgagccataagccgaattgcatacaagaaactgactcaaatgaaccagagacataaacaaaagagccagctacaaaaacatactgcaaacaaaacagaatcaatgtccagttttgcatagagttaggcctatatggtactaaagaaggacaggtgatattaaaaaaaaacaacaacaaaaaacagaaacaaacaaacaaacagaaagtccgtagatactgcattaaagctagaggcctgttatcatgggagtaccagaggagctgaacaagagttttttttattgctcataggagaaaacttgaaaccaggatctattgtaagttgaaatccacatctcttagaaaattctagggtctgatctgagaacaaggagaaaacaggtagttgtgaagtctaaaatgattcttatttacgttatactcccttataatgtggattctgagtaaacaaagcagtaatttcaagctgagctctggttttccaatagcacactcatttacttgcaaaacatgacttgattgaacaccactggccagctgttgtgtgccaactgcaggggcagataagctccggtctacatgtttcttcttgtatgtatagtctgtatcattctcaccaataacctcacccagaatctttcatcaaattgtgcatatgtgtgtgcacctgtgttgggtgcatgagtgtgtgtgtgtgcatgtgtgtgtgtgtgtatgtgcatgtggtatgcatgagtctgtatgtgtgtgcatgtgtgcacctgtgtgagtgcacaagtatgtgcacatgtatgggtatgtctgtatgtgcatgtgtatgtgtgtgcatgtgtgtgtgtgtgtgtgtgtgtgagtgtgtgtgtatatgtgtgtgtgcgttgtaacatttttctagccaacatcactgcattctaggaatgacagcatttttcctcagagacttaacaagttgttaaaaaaaaaaaagctccttgtaaatatgaacagattacttttctaaacctagaaacttgccaatataaaatacaaggcttaaatttattcaaccaatttccctcatgctttttaatagaaaccactttaagagtctgagtccagccaccaggaacccacagatgtggggatgggggtgtctgttagtcccagctctttcttacctctgcatagacccacccatacagagggtccttttctcacatcacctcaggtcccaggtcccaggacctctgtgcggtttctgttcccagtttttcaatcattgttcctttcttatacgcaagggtctccatccctctactcatttagatgtctcaactacaaggtcacatttctacctcctttttctcttcaagcccctctctcctatcatctctttatgcggtgttctttttctttaagggcctttgatagtcctttgtgcatttttttctaactttattactagactgaaggcaacatatgggcatgaatttccttgtaatttccatctttcaacaccttcggacaccaactagagggctttgtaaaaaaaaaaatttaacttggatgtcactttttgacatcttggcatgaaaggatagagaggagttatgctggcaagggctgatttccttttcggagtcagggctaaccagtggttctaccaccacacagacatgagtgttctagaatacagaagctatggcaaggctgcctgagttcaagtttgtgctctgccacttatctgtgtaacatttggcaaggcaatctagtctcatagccttcatttcttcccttgtcaaattatcaatattacatagttcttacattcctgaagtactgcttagcaaagtaagtactacctctctataataagttgacctctaggtacgtagataaaagagaagagttacaagcacaagtggagccactttgtagatcatctggatttttcagacacgtgtgcaccaagagtaagtctctttctacagcctaccctaagccagagaaacacaaacggagctgtaaattccgcttaattgacatttcagaatttcaaagggaagtaattgcgtccctgagcttctctgcactgatccagagtgggacacatctcagcccatggattgctgtggttctctttctttccctgcactctttctccccctcccactcttccaagtcagatcaggccttcttgctgaaggggaatggaaaggagtacctggcggatttcatcttcttcacctaacctggagggagaggacaacttggatagaacttggcatgcctggttttactgccgtggcccccgaggactacccagatctccgctgtccacagagaatggaaattaaattcaggctaactttcatcatcaggaacactcagataatgtgttctgatcatcatgtgcctgtgtgtgtgtcaattttgagcaactctccacgagagaaggcttctcagtggaatggagtcctgagtttctggtccttgggttgtgtccttctgtctgtccacttgctcctgatctttttggatgggaaggcagattgtttgctcttctccccagtgccttcttggatactgtataattaattaggcctccaatcatgccttcccagcctccacggatggagaaaccctctccgccatgccttaaagaggaattgctgtaataaatgagtctcctgatagcaaatttctcagcaagggggaatcgcgtaaatggagacatagtattgacagcaaagtccaatgtgttatttttaccagaacgaactctccggttcaagcctttgaaagagacatttgaaaaccaaaaacaaacaatgtaatggagcgaggaaaaaagccacagaagtgagtggcagggagtttaaaagagcagatgccactgccaggtctatgggacataaccagccacttgtgctgggtcttggcagtttataatgctacctcatcttctccgcgaaattgttttcccgtaaatctctgtggccatccattcctgtctacacattatgttcctaaaatagacaccatctaaaaatcacttcaaggagctttgtggaggaaggcctaaattgcaacactcctccagcgaagatagatgcagtgtttgatggcattaccagtcggtagccaggaaggggagtttgtgaggagtttttccaccacagttaatctgtttctggaaggaaagggaagtgtcagacttcccgaggaggcaaacgtgtgtggaagctctcatttgcatcacccccggcctgtcaggtattgcagcaaaagggagaggtgagctaccctggctctccttgggcaggagggacagaatcaggaagcatcaacctcagcatggaattttcctattcctgtttggcatcctcctcttgggatgatttacagcgcgggttggagaaacacgctctgccactccactagcgcaccagatagacagtgcagacctgcagatccatacccgaggagaagccacatttcctacgtgtgatagcaacagcgtttggcaatttgcgactttgctactgcagcttagaaaatatttagtcacatgcacatctgaacagaaagacacccaggcttgactcagtcatttccgtcagacacacgaaagaaaaagcgtctctgctcacaagcttatttggactgctttgttgaaaggaggggcggcagacactttgtagatgtggcaagagggctttatatccagacctcaaacaggtaggagagaaggaagccaggagaggtaaggaaggggcgtggaaaagcctcacagccacctcgaagaaaacagtttttttgccctgttcagaaagcaagaggttccacagtggttttgtgtcaatggagcacatctgcagtatcattgccgttggtgacctctgtctaattaaaagtaagtcagtccttcccacccggcattgtctgaaacccgggactctttatcactttgctaaagttcatttgcaagtgtagttaaggaagagtcaggggggaaacagcatctgtcccttctggtcctggggaggaggcactcctttccaagagtcaagcctctgcccaaagaagctgcctcccctgcaatgctaggatccaggagcagccccgctgccttcttgcttcctctgtgaggtctaatttttgcatcatctttaggagcgatatgacctctattcacagccatcgaatccagttccaaagcaccaatgacagagggggcttcaagacaagaccttgcctaggaggatgcaggcaagcaaaggcaagagctggcccgatgccaagttattttaggccaaagaatctcatccttctatcaaaatgctgaactgcaaaacgaacctgatttcagttcatggaaggttgagaggaggaggagggggaggggaggaggaggaagagaggaggaggggaggaggagggaggaggaggaggggaggaggagggggacagttggtccgaattcacatgcaaaaatagacttcctgttctgccccaactcttatttccgtgggctcttctccccaaggatttaccaggtaagaattcaccaccaaagaagatcacaatgagataatcagatggcttacctgataaaaaggaaaattatccatctgcagtgaggagcaacatctccccacgacgagtccgcaccttccgttgcaacgattcagattccttcttgcaaaaggtgaccaagtgcttcacaagggctgcagcctcataggggcagaacacacgtacacaaacacacgcacacacacacacacatgcaccagagacctctgcagtatcctctcggcttcatcctcgcctcactctatggtacctaatacaaatcagcaaatagcttgttttaaaaaaaaaagaaagaaaaaaaagcggagacagcacctaacgttacagtgccatctagtggctacatcgtaaataggttctcacagcctggatttctgtgttctttctcaaccgcttccttctggttcctttttcttttttcctctttattttggttttattacttcctcagatgcctttttttcattcccctttgctctgcctatcatggaactattgacttaaagattaaaacaatcagaactggagagcgttgcttttaagttaaaaaaaaaaaggtgctaattttgtttgtaaatgttactttattttctctattaaaaaaaaaaactcattgttacttttacagattacggaacccatgaatgaaatttgcttatttctactgtctggagaaaagtgagtagtcttttactacgtagtcgtgactttacatgaggaattttgtggattctttcttctctaacaccgtgttcacggtgcttttcatactatagtgagtggctctgaaggaggcagatgcgagtttaattttaaactcagtatcgatgagtgtgttttgaagattatatccccctatctttagtattgatgttaaataggattatttttatacccatttccatggtttcaccatcttttattgtaatatatctatttgtctcccagatatgactagccattgaattgtcacactatgttttagagaacaaacgtaagtattaaatattattggtgtccactaggtcttcccaaaacaatgaggagcccatactgaagtctggggagctacaggaactgaactttctaagccatatattataatttaaagcatcattagtctttcacatttggtcatacataaacttatttaccctgggtgtgtttctcttgtcacttagcacacttaatgctgatgaaagtcaccatacatgctttgctattaaaaaaaaaaaaaaaaccaatatcccttagactttaatttgtctattccatactacaggacagggaggcatatactgttaatattcctctagcaattctcattgtatgttgagaataatgagacattctgaaccttattgagacttttctagaccacatagtttgtgaagcaaaacaaaccaaccaaccaacaaataaataataagaataaggataaggcccaccctttcagaattcattattttttggaaaatagtaaatattttacctctttccattctagaatcctggagatgtaattttcattgtttctttataaagaaattttacaagtccttgtttatgggttcatgggtccatctcctgggcccctttcttagtttctgaaaggaagcaattgaccaaaattgagctggaagtatatagctcatttggtagaacacttagtagacatgcaccaaaaaaccaaaacaaaacaaaacaaaaaacaaaaaaacccaaaaccaaaaacaaacaaacacacacacacacacacacacacacacagattttcagccttgtagactgcttgtacaataaaaacttcagaacttggaatgctgaggtagactgatcacaaatatgagttcaaagttattatggggttagaaattccatgccaacctcagcctcagacatagtcacaggctcagcctcagcaactaccacagccatggtcacagtcagagccacagccacaaacacaaccacagtcacaggcacagcttcagacacagacacagagagagccacagtcagggcctcagccacagcattagccacaacctcagccacagccacagctacaggtagagcctcaggcacagacagacacaaacacacaaagacgcagccatagctgtcaaagtcacaatcacagtctcagcctcagacacagactcagccacagcttcagacacagacatagtcataaacacagagaaagtcacagtcatggacacagctacaaccacatcctcagcttcagccacagccatagctatagctacagcctcagacacagacacagacagacacagacagacacatacacagacacagccatagctgtggcctcagaaacagactcagacacagccacaaccactgccacagccattgtcacagccactgccacagccactgccacagccactgccacaaacactgctatagccacagccactgcaataggcactgccacagccactgctatagccacagccactgcaataggcactgccacagccatagccactgctacagccacagccactgctacagccacagccactgctacagccacagccactgctacagccactgccacagccactgctacagccactgccacagccactgccacaaccactgctatagccacagccactgcaataggcactgccacagccacagccactgctacagccacagccactaccacagccactgccatagctgcagccactgctatagccactgccacaaccactgccacagccactgctacagccactgccacagccacagccacagccactgccacagccactgctacagccacagccactgctacagccactgccatagccacagccactgctataggcactgccacagccacagccactgctacaggcactgccacagccacttccactgccacagccacagtcaaagtcacaaacacagacatggccacagtctgagcttcagtccgcactacataatgagaagctgtcttcttaaaaaattaagttaacttcctgttccatctccaaaatgcacaataatttgtagctcttcactgtctgaaaaaagtgttgctccttctctggttcaggctgagtaacactggaagaagctggagtgaccaacacttggtaactagttactagaaagtttgaaatgaaaaggcagaagggaacatttgaactaagaagtagttttatatttatattatgattctaagaccatatactccatatgaacagtacttaggatttaaatatatgcacataaaaataagaacatccaaaagacatactttactacttactaatagcatattccagaagtcaatgttgtgcattttttcttaataataatatcaacatctctccttccttattgccagagtgcacttggtcccttgtctatagaggaccaggagggcgtgggtggtgtgttcccagctgaaccagtctaaagaactatgacatgactgccatctatggaactaaccttctcttttctctcaccatagcattagaagcaggtagggcaggcaggatgcctacaggaaatgtcacagctaatgaagaatgagggaaccatccaaagccagtgcactccctgggttcctaatgatatcacaggtacaaggcagaatctcagaagatctggaacgtccctgatttgagtatacaagacagcccctaaaaagtctctggaccaatctcttttgatatccccgtgtactcaaaaccagttgatttatggagagaggagtttaagccctgaagatatcaaatattggttatatcatgggtgtccaactctgaatttactcacttcaaaagtacctgctaataaaggcattttcccaggcttaattaacaccattaagccaagcaaatgaactcttactttgagaagtttccatctcacaatgagagtcagtgagaaagggagagtattttcaatgcatgcacccctcttccttcggtttgcctgtttctttcatgacttctgcatcttaacaaacatccagccatctgcacaaggcaaagtggaccagtgtctaggtcaaacatctttttctctaatgctttccctgtgttttcagtgaataggctccttttgttaattgtaaaataaatttatgttttcttttatggaatatggtcacggattatattgaaaatgttaatcgtgagagaataaatgtttctttgcagactgtttctgaagaaggttaacattccattcactgtacaagagtgctttttaatgaataaaaaatattcattaaatatagcttgtcatttagtagcagacacgtgattcatcagagtggtaacaacaccaactgctttaatttttcttcatctaagacctgccatgaaggaaaagacaagatttttaaaaattagacccttaaaactatgtatttaaattttaaatgttcactttttaaacataaaaatgtaaactaaaaagaaccgtaaaactttatgctgctctcacccttgtgtttgctggcctctctggacttttgctaaaggtctcccatttctatctgtctaccttctaataatgaactgcagttgggctggcatattatatcccatataccttttgtggtatcttagttaatgaagaaaagtttttatttttcacttttccctggcttatttccatcaacaaagactgaaggggccatttccttatttctgggagaccccatgtgatctcatctcagaaaagagaagaatgttatttcttggctgtctctacttccctagatggtgggtgcaggaacttgacaggtaagctgtgggctgtgcctcttctgtaagcggttccaacaagagaagaaaatgagaacacaaaatgtcttgtcattgcttttgccactctgtctctgtcaggaggacacagccatctctttgccattactctgtggggcatgggctctgcacagacaggatggtctccagttgagctgaggtctgaaccccgtttgtgataattcacctaaatggcacggtaggcgttccctcatgctcctggaactctggctcctgcctaagttactgccccccacaacccccacaagagaagcatggtcagtagtcacgtaggcaatggcccaagcttctgaccttcaagctaaactcctcccctgttacctagcaatagtgaggaccataaaaagggctgtttagcccctgcttgctctcttacctcttacttctcactctcttacccctcactctcaccccctctctcctctctctttgtcttctcttctctttcctttctctttgccttctcctctcctctcctctcctctcctctcctctcctctcctctcctctcctctcctctcctctcctctcctctctccctcttactctctttctctctagccttctctctctctcccttctctctttctccctgcctttctataataaagctttaaaaccatagagagtctctgctcatcaagatccgcttcatgcactctcacaggtgttgggaacctcttccctcgtcccgctcttctataaccctggtggctttagcaaggtagctcctggatccccaggtagggctgccccttggccacccgctgaagagtgggtcagaggcttgaatgcccacccagggatgagtggaaagtgtatggcagctctcccatgcctgacagaccagagaataggtaaaactctggcggggtgtgagtcccccccttccctagggaccccctttttagttcccaacattactccatcacttgctggaaagcattagctgcttagtggccaaagaagggagattacaagagatgttacctctgttggtagaatgtgggtattaaagaataaatgtgggattcaagtggaaaagatagcctaggttctttctacctatcagttttaagataagcaagaggatctcttgtgattagcatcttgaatgattcaaatgttctcaagaccagaaggcattaaaattccacagtgaaattcgtaaaatctcctaacatggaaaaaatatcctttgttaatttcaattttagaatgttaattgtcatgcattgtgacaaccactgcttgaatatattttttgataatcattaaggaattgtggaactggaaagttttctcagaccatccagaagacgattattattttggataacagaaatgtgacatccagagagatagtatgtcttgttcaaggctatacagacagtttggaattgtaaaagttcattcaaactttcttccccgtttaactatgaagaaaatgaatattgagcaatgacatcggcacacaagaagtgaaatggaagtgaggggagggtttctggatataccacgattgattttccctaatgatttgactaatatgaatgaaataggaggatataatagaagctgtctgtttaaaaaggtgatggaccaggagggacttccagtggagggaggggaacaccaacctattcacaaaacctttggccccaaatttgtcctacctataatatgtgcagggataatatatggggcagagattcaggtacaagttaaccaatgacttccccaactttagaagacccccgcccccatgggagatctaaatcctgacactcttagtgatattctgctatgcttgcaaacaagacactagcataactgtccagcagccagtggaaacagatacagagtcccacagccaaacattaggcagaactctgggagacttggggaaggatcgaaagagtcagaggggtcaagaacaccacaagaagctctacagaggcaactaacttgagcccatggggctcacagagactaaaccaccaaccaaagagcatgcagaggctggatatggaccccttagacatttgtagcagatgtacagcttggtcttcatgtgggcctcttaaaaatttgactgggggttgtctctgcctctgttacctgcttttgatgccattcccctagctgggctgccttgtctggcctcaatgggagagaatacatttcgacctgctatgatttgatatgccaggtagattggtacccatgggggttctctgaggagaaggtgaggtggcactgagggagcagtatgtgagggcaggcctagcagtatgtgagggcaggcctagggagagaggaggtagaagggttacatcaggatgtaaagtaaattaaaagaaaaggtgaaaggctaaaccaatattgggttaagcactgatcaccctcatgtatagctttgcagacagttcttaaaaattgaccacaaacttctcaaactcaaggacatgagagtacaacactcatgactttcattcatgtccaaggagagacctggaagaaaattgtcccaaggttctaaaatttcattacaatctgaagtaaaatctgaaaacacattttatgtttccttagttaataaatcatagcctcgaaggaaaacaaagaaaccttttctttctttctttctttctttctttctttctttctttctttctttctttctttctttctttctagataaagtcatgatcttgtcttgtgtaccttcaaagacccagacctaaatggtccttctgtcttgcctttcaaatagtcaggactgatggcatgtaataagtaataagggctggaaagtaaagtagtatgctgctcatgcctacattgtatacctcactggcaaacagatcaaggactaggccttagccttggaggcaagatctaggcatattacagtatttcaattaatttgtctggatctactcttacagggggatgaagagagaatgaaactataacaagaaacaaagaaggtacatggaaagtcataaaggatttggtaactatgctggattctcttctgtgctcatacatactggcttttatgtcaggaagtcattgaaatatattgcctgggttcctccctcatccctttcactcaacaatcctcctcctttgcagaggtaagccaactaaaactgtgacaaaaatatcatcaattacttattggatttcaaagagcaattttccatttgactatattttgaagtcaatcacagcacttgcctatatatgcaagagatctagcacactttaagtttacagattatttttgatattaaaggaaattgctgatatttatgaagacaactcacttttataaaataaaactgaactttgccatgacttaggataagccaataatgtgtaggcaaatatgtaattcctattcccctgaaggcttattggtgacatctttttcttttcctgtttaaaaggaaaaaaatctactgaccttcctaggaacctctcacagtcctcacactgtgtgtgggtgtcattacagccaagtgccatcttatttcacatggcttagtgatcattgctgaagaagtggaggaaagagtgtgagagacagaggaacagcaagctttctgtgagactgggtctcctagaaatgccagagagattacacccatagagtctcatcaacatggctgcctaaataagacctgaacaatgacaacaccaatggccatactaacatgcaactggggaagataaggaggttcacactagaggaagaactatggacaatagggaaatgataagaactggagaaatggttttccctgaggaagaactccccaattgttatctgctataaagtggtcagccctggcataagatgcatacaggtaacactatatggactgaccaggtttacaatatcacagtgaatgctatgtgtttcatatatacaagctatctatctatctatctatctatctatctatctatctatctatctatctacaattaaataacaaagatgccatgaatttggatgaaagcaaagagggttacatgggaagagttggggagagagaaagggggtcatgttctaattgtaacttagaaaacaattttaattactataaaaagcattcataggtttagcataattcatagaaacaagctctctatgataaatgattctacttaacaccttgatacttggtaccatcctgtggtaagataggttctcagaaaaaaatgtattgatacttaaatatttatttctctttccaggtcaaaatttgatagtgatttcaaatatatggaaattattgctaaaacttagtataggctgagtatttgaacactcacaggaaattcatgacattgatatttttgccatcattttataggttagaataccaaaaaccaaaactatttatcatttttgccaaggagataaaatgtagcttggaaaatagcagcctatcttcaaagtcgggtccttgttttatagaaatctctttctagcaccacattattattatgctattgtcaagtctctgggatccaaggggaaaataggagatggtgcagctcttcttcactggtctgggaaagatcacaatgtgcttacatagacaccatggatgaaacatatttctaaatgtacccaaggaaagggggttttgaggtacaaggcaggctggcagccacagttccaacaaatgtggtattgggtatgtggccaagaaggaaagtagcaaatgacacctctttttacttgaccctaagtctcagatctcctactgcagggtggtggactgtaaggtatggttgagccaaaggcttgatgccctggagaccctgaagatttagtaggagcttcgcctgctctcagcaccaatcccctgtcatatagccatagccccctatagatttgtggttatcagtagctgaagggcaatgcccaagcccttccacatatagatgaagcatctctaacatctcggaccaagaggcatgactacagtcatgtaagctcaaaacagagttctctatgccaatgaggtacctagaggtcgagagggcattccaataagcttcctttcccatacatttctccctgcaaaaggtatatcatctcatgccaaccctgagaagtggggtatggttctacagatccattttccaccatgacaataataaactgtttgggaccatggaatgcctctttttttattgtgatcaacagtgggaagacatggagaaggccttcgcctacagagtcacagtctagtctctgaaagaaggcatctttgcattctcagccacgatcaccaccaagcctgccactatcaagccaaagacaatttctgcagggactagctggagctcctcccccatgtccaagatcctgagaacccacagttctggggagcaccgaaccagtacggagtcaaactcccccatccagtctccacaagtggccgtgctcagtggtgggacagacttgtgatgacacaaccctacatcctacaacatgtgaaaggatatgactgtttggaaattctcttgccaaatgaacacatcaactaaatttcagaggagcattcaggggagaagaatctctcagtctgtcagtaccttagtatccacaagtcgacatttgttgaacataaaaaaatgaaaagagcagaatttctgagtgtgagaggttgacaatgaggcttctgacaaagcttcatgtttcaaatataatattcaatgtcatgtttttctttttctcagcacattttttgaaaaggcaagtgctttctggctctgctggatatttgtgaagacacggatcacatgagaacataaaactttgtaagctttaaagccttgcttctcgtccgagtgtggcagtggaacaacagcatctccatctttgaggggcttgttaaaattttggaccatttcctttgtcccacaacctgccagatcagaaaggacgttttgacgagctgcccatgtgattccagtagacactgtttaaaagtgttgctgtagagtgccgctataacaggaacttgagaacttaacataactgatgttatgacgcaagtaccattccctaatgctcctgcaatcttttcatatcacctcaagttgtagggacagccaaccataaaattatttctgtttctacatcataactgtaatttttctaccgttatggattgtactataaatatctaatatgcaggatagtcttaggcaatcgctgtgcaagggtcatttgtccccaccaagggttcatgacccacagattgtgaactacccatttagaccctaaaagctcagcacatagacagtacacaacaaagacaaagatctgatccatcaaagttcatagttctagaaccatctctaaatgcaccacctttggatttttggcttctgtagttctgctttggctaactgttcttactaacacaattccggaggtggtttcactctgagaaaggttcaggattatacaggatcatgaatacccagtgttgtctctacccagctgataaagactttctattgtcttaaacccatgtccatgcactcttctctggtggacaacccacaacattagctaatactttcacacctctcataagagcttttatttttaattaaattttaattttgcatgcaaaataatgtttttattatgacattatatatatttatccatatatgcataaatatatacatatatgtcattacatatacatatatataatgtctatatatgtatataacaaatcattgttcttatttgtttaccccttactcctctacccttctccaacctcttctttttggtctcctttctcctcctaaataaacctcccttctgatttcatgacccatgtgacctaacgtttataaggctacctatttttctgtacccagagcatgtgactaaacaatttgtcccttctcatcattttctgggcactccacactccaatccagagaagctatctcctaatctactcttgaagtaacagtttgaaaattagatcaccatgctggctctttaagtaaaacctagccttcctatttactgcacaggtgcaggccataccagtcagaaaagggaagagccccaccagataactgaaccctcctgataactaggtttggagcccaaacacccaagccactgacaccaccaccctactgcctgctcccacttcttgcacttgcctctacgcaggtgactctccagagcacaggtgcaggccaggctaatgagaatgagtaagaggcccatctgcactcagaaacctcctatgcccttggtttggatccccaaggcacactctgtagacatcctttctgtgttttatcacccacagagctcagttaatatttttaacaaaaccatagaggaaaaatttcctaaccttaagaaggacatgtttctaaaggcagaaaaatctcttaagacacaaatggattgaattggaaaagaaagtccctggtcaactaataatcaaaacactgaacatgcagaacaaagaaaaatattaaaagctgcaagagaaaaaaggccaaataacatgaaaaggtagaattattagaattatatttaatttcttaacagagaccctaaaagccagaatagcctggacatatgtcttacaggctctgagagaccatagataccatcctagactcgtctaacaagcaaaacttaaaataaaaagatttatttttatatgagtataccactggtctcttcagattcaccagaagaaggcatcagatcacattacagatgtttgtgaggcaccatatggttgctgggaattgaacttaggatctcggtgctcttaatcactgagccatctctccagcccgccagcaaaactgttcatcctcatagatgggtaagacaagatactgcatgacaaagtcaaatttaaacaaaatctactcataaatccaggcatatcgaggtacaaatggaaatcaacaaccctaggaggttaactacacccatgaagaaataaataagctcatacaaaaattagagggaaacacacacacacacacacacacacacacacacactagcactaccataaacaacaacaaaataataagaattaacacttattaatcattagtatctctcaatatcagtggactcaattcctcaaaaggcacaggctaacagaatgaataccaaagcaggatttatccgtttgttacatataagaagcacacctcatcatcaaagctagatattacctaagagttgagggtttggaaaaagattttccaagcaaatgtacccaagaaacaagctgttgtatctgttgtaatataagacaaatcgacttcaaaacaaaaattaatcaagtagacagaggacacttcatatttaccacaggaaaaccccaccaagatgatgtctcaattctaaacatctatgcccctcaaagcaaggacacccacatttgtaaaaccacacatcaaaacacatgtattaagtcgggcgtggtggcgcacgcctttaatcccagcacttgggaggcagaggcaggcagatttctgagttcgaggccagcctggtctacaaagtgagttccaggacagccagggctatacaaagaaaccctgtgttgaagcccccccccaaatatgtatttacagtgggagacatcaggtcattcagacaaaaacttaacagagaaataatggagttaacagactaacagacttaacgtggacttaacagttatctacagaacatttcacccaaataaaaacaatatacattcttctcagaaccccatgaaacttctttttcaaaattgaccacagactctgttacaaagcaagtctctacagatccaagaaaactggaacaactcccccatctcatcagaccatcatagattaaagatgaattttatcaacaacagaaagaacaaaaagcttaaaaacttatgtaaactgaacaactctctactgaatgacccctgggtcaaacagaaataaaggaagatattaaagactttctagaactcaatgaaaatgaatgcacaacatacacaaacctatggcacacaatgaaagcagtgctaagcggaaagttcataacactaagaaccttcatatagaaattagagagatttaatactagcaacttaacagcacccctaaaagctctagaataaaataagcaaatacacccaagaggagtagatggcacgaaataaactcggggatgaaatcagtaaaatagacacaaagagagcaatacaaagaattaatgaaacaaagggttagttctttgagaaaatcaacaagacaaaatcaacaagacagacaagccattatccaaaccaactaaaaggcagagagagagagagagagagagagagagagagagagagagagagagaatatcttaacaaaatcagaaaagaaaaggggggcatgataacagatactgaggaaatacaaagaatcattaggtcgcacttcaaaaacttactccacaaaattagaaaacctaaaagaaatggacaactttctcaatagataccacttatcaagatcagataaacaattaaaatagacctatgacctataaggaaggaatcacaggaagcagtcatttgaaaaggctcccaactcccctacctcacaaaaaggaaaccctcaaacaagagctaatatcaataatccttaaattattccacaaaatagaaatagaaggaacatcaccaaattcatttcatgaggccacagtcaccatgatacccaatctgcaaaaagactcaacaaggaaagagaattacagaccaatttttgcccatgaacattggtataaaaatactcaagaaaatatctacaaactaaatccaatatacataaaagatgtgttcaacatgaccacataggacacatcacagagattcagggatggctctacatatgaaaatctgtcaatgtaattcaccatacaaacagtgaaaaaatacccgacgtgatcatctcattagatactacaaaagcctttaacaaaacacaacactccttcatgatacaagacttagagagatcaaggatataagggacatacctaaacatagcaaagacaatatacagtaggtggatagccaacatcatgttaagtagagagaaactcaatgcaattttacaaaaatcagggacaagacaagactgtccatagtacttgacattctagctagagtaataagacaaccaaaggagatcaagaggaatacaatttggaaaggactaagtcaatgtattattattttcagatgatatagtagcatatacaagcagcccataaaatttttccaggaaactcatacaggtgataaataccttcagcaaagcagctggatacaagattaactaaaataaataataaataaataaataaataattcagtatccttataaacatcaaatgggttgagaaaaaagaaatcaaggaagcaacacacttcatggtagataaagataatataaaatatattggggcaactgtaactaagaaactgaaaagcttatatgataaaagctttaggtctttgaagaaagaaattgaagatgtcagaagattaaaagttctcttatgctcatggacctgtgagattaacatagtaaaaaaaagcaatctacagactcaatgcaaaccccatcaaaattctaaaaaaatttctttacagacctggaaagaacaattctcaacttcaaatggaaaaccaaaaaaccaaggatagctaaaacaatcctgtacaaaaaaagaacttcctaaaactaccacacccctgattctaagctctttgacagagctatcatcataaaaacacatggtataggcataaatacagacaacttgatcagtgcaatcgaatcaaagacccagatgtaaatccgcacacctgtggacacctgattttttattaaagaagacataattatacaatggagaaataaagcatcatcaacaaatggtgctggtttaactggatgttggcaagtagaagactgcaaatagatccatgtatattaccctgcacaaaactcaaggccacatgaaccagagacaccaacatcaaaacattgcacctgatagaaaagaaaggaatagccttgaatgcattggcacagaagacaacttcctgaagagaacatcaatagtgcaggcattaagatggacatttaataaatgtttcctcatgacactgaaaagcttctgtaaggcaaaggacaccatcaaaaggacaaaatattcaaggtacagaatgggaaaagatatacactaactccacacctgacagacagctaatttctaaaatatgtaaaatcaagcaagcaagcaagcaagcaaacaaacaaacaaaaaaccctcaagaatctagacatcaacaaacaatccaatttaaaaatggggtacagctagttgtggtggtgcacacctttaatcccagcactcagaggcagaggcaggcagatctctgagtgaggccagactggtctatagagatatgtccaggaaagacagagaaactctgtcttaaagctccttaagacccaactataccaatcctgagcatatacccacagaacagtccacaaggacagttgctcaactatgtttataccagctttatcatgaaatttgcaggaaatgaacagatctagaaaaaagtcatccatagtgagacccagagagaaaaacacggtacacattcagttataagagtatattctctgtaaagtaaagaatcagactcagagaggctaagcaacaaggaaggctcagtgtgtggggggcacatgaatttcccttggaagataaagtagaatagatattgtgggtagactaggttgggtagggaggaggacaagaagaatcatgtggggaagggggaggacatggagcaagcgagagagagagggagagagagagagagagagagagagagagagagagagagagagagagagagagagagagagaactggaaagaggagaaggacattttggcagtgatgcagaaacctaacacaatggaagctcccagcaatctacaagggtgacctagctaggatccctagaaagtgaggacacagaaccttaactagccatctcctataactagatatccagtggagggattaggataccaactcaacctcagcacattcaacttataatttttcctgcctacaagatgtactgtggtgatacaaaaattgggggagtggccaaccaatggctggttcagcttgaaacccatagagagagagcccagggctgatactgactggaaggtcaggacccagagagaggctggatatcccagacacctcagatagaaccaaacactattgaaaaaaataagtcaatgaaatgattcctagttaggttctgctgtacttgtagacaggagtctagcaccatcatcatgagagtggtttcatctagtaactgatgcaaacagatgcagagacccacagcctaacattaagtggagctagaggaattcttggaaggagggcggagttgtaggagctagctgggtcaaggatgccacagaaaagcccacagaatcaactaacctggattaataggggctcacagacactgaatcaatagccagtgagcctacatggactgaccgatgccctctgcatatatattatggttttgtagcttagtcttctgtgggacttgtaacagtggaagcaaggggtgtctctgtctcttttggcctgcttttgggaccctcctcttttccactgaggcaccttgtccagccttcatacaagggaaggggcctagctttgttgcaatttgatatgtcatgtttggttgctatccctgtgaagactgcccttttccgatgggaaatggaggaggaatgggtgaactgggaggaggcaaaggggaggttcaggaggagtgaggggagaggagacagggtaagctgtgaactggatataatatatgaggagaaaaaataaattaataaaagagagagcaacagcaatccacgttttctttgcctaagcagattctacacaggtagtagacgtaaacaattccttttctgaaactttatgcatgtgtttaagtacatgaaattcagttttccagcaatgatatcatgcgctatatatagctacataacttgtttggtttaaatgacctcatttacttccttgttattaacctaaaagcacctttccactatacaaaattttctctaaagtacgttttgaggaaacatctgcttttacacaatggcagattccaatcagcttccctgcaaaggtgtggtgctgttgaatactccagcagtagtaaccttgccttcccacagttttgttttctgggagggcacatctaggcaacgccttgattttgcttgtcaatttacctgaggcttttgggagggccaggtgatggttatgtatacacagaaagagggtcagatccaagcacacggctagagcgcggcaggagtggtgaggtccagatcccatgggcctagagcatctgacaaagacagaaaactggagccaggctcacatggaaatcgggaaaaccatgctgagaagacaacagcaaggacttactgcattgttcctttcttttaaaaaaattagatattttctttacttacatttcaaattttatcccctttcttcctttcccctctgaaagctatcctgtctcaccccctcccccctgcttactaacacatccactcctacttccctgtcctggcattcccatacactgggacatcgagtcttcacaaggctaagggcctctcctctcattgatgtcccacaaggccatcctctactacattgagtccctccgtgtgtactctttggttggtggtttagtccctgggagttctgggggtactagttggttcttattgttgttcctcctatggggctgcaaacctagtcagctccttgggtcctttctctagctcctctattggggaccctgtgctcagtccaatgcatggctgtgaacctccacttctgtatttgtcaggcactgggagagcctctcaggagacagctgtatcaggctcctctcagcaagtacttgttggcatccacaatagtgtctgggtttggtaattgtatatagtacggatcctcaggtaggacagacactggaggccatttccttcagtctctgcttcccactttctctctgtatctcttcccatgggtattttgatcccccttctaagaaggatcgaagtatccacaccgtggtcttccttcatcttgagattcatgtgatctgtgaattgtatcttgggtattccgagcttttgggctaatatccacctatgagttcacagcagccttatttataatagccagaagcaggaaataacccagatgtctttcaacatagaaatgtattattcctttcttacagtaagagggagatttctatttccttacagggcagtgacataatagtagcatccttctgattggctaaattgttcttcaatcacagttgagaagttatatctgtgagagagggttgactgctaggagaacaatgattagtaagttggaaggacaaacgaataccttttctgtcctcattgtacggatcaatacaaatctacttctaaagccggacgtggtggcgcacacctttgatcccagcactggggaggcagagggaggcagatttctgagttcgaggccagcctggtatacaaagtgagttccaggacagccagggctacacagagaaaccctgtctcaaaaaacaaaaaacagttccaggactcagcagaacttaggaaattagtctgaacaggtgagagggtgcgccagagaaccggacagcttctgggataggcggaagcacagagccactgaggcagcacccttggcgggctgcagacagccggccaccgtccggaccagaggacaggtgtccgcctggcttgggaggcggcctcagcctcagcagcagcggtcgccatcctggttccaggactccgtggaacttaggaaattagtccgaacaggtgagagggtgcgccagagaaccagacagcttctgggataggcggaagcacagagccgctgaggcagcacccttggcgggccacagacagccggccaccgtccggaccagaggacaggtgtccgcttggcttgggaggcggcctcagcctcaggagcagcggtcgccatcttggttccgggactccctggaacttaggaatttagtctgcacaggtgagagtctgcaccacagaagctgacagcttctgggaactgccaaagcaacacagcttcggagaaaggccctgttttgggccttctttttcggccaggaggaggtccaaaaacaagatatctgcgcaccttccctgtaagagagcttgccagcagagagtgctctgagcactgaaactcagaggagagaatctgtctcccaggtctgctgatagacggtaacagaatcaccagaagaacaatctctaaacagagtcaactctaactactaactccagagattaccagatggcaaaaggtaaacgtaggaatctttctaacaggaaccaagaccactcaccatcatcagaacccagcactcccacttcgtccagtccaggacaccccaacacacccgaaaacctagacctagatttaaaagcatatctcatgatgatggtagaggacatcaagaaggactttaataaatcacttaaagaaatacaggagaacactgctaaaaagttacaagtccttaaagaaaaacaggaaaacacaatcaaacaggtagaagtccttacagaaaaagaggaaaaaacatccaaacaggtgatggaaatgaacaaaaccatactagacctaaaaagggaagtagacacaataaagaaaactcaaagtgaggcaacactggagatagaaaccctaggaaagaaatctggaaccatagatttgagcatcagcaacagaatacaagagatggaagagagaatctcaggtgcagaagattccatagagaacatcggcacaacaatcaaagaaaatggaaaatgcaaaaagatcctaactcaaaatatccaggaaatcgaggacacaatgagaagaccaaacctacggggataataggaatggatgagaatgaagattttcaactcaaaggaccaacaaacatcttcaacaaaattattgaagaaaacttcccaaatctaaagaaagagatgcctatgaacatacaagaagcctacagaactccaaatagactggaccagaaaagaaattcctcccgacacataataatcagaacaacaaatgcactaaataaagatagaatactaaaagcagtaagggaaaaaggtcaagtaacatataaaggcaagcctatcagaattacaccagatttttcaccagagactatgaaagccagaagagcctggacagatgttatacagacactaagagaacacaaattccagcccaggctactatacccagccaaactctcaattaccatagatggagaaactaaagtattccacgacaaaaccaaattcacacattatctctccatgaatccagcccttcaaaggataataacagaaaaaaaccaatacaagaatgggaacaacgccctagaaaaaacaggaaggtaatccctcaacaaacctaaaagaagacagccacaagaacagaatgccaactttaacaacaaaaataacaggaagcaataattacttttccttaatatctcttaacatcaatggtctcaactccctaataaaaagacatagactaacaaactggctacacaaacaagacccaacattttgctgcttacaggaaacacatctcagagaaaaagatagacactacctcagaatgaaaggctggaaaacaattttccaagcaaatggtatgaagaaacaagctggagtagccatcctaatatctgataagattgacttccaacccaaagtcatcaaaaaagacaaggaaaggcacttcgttctcatcaaaggtaaaatcctccaagaggaactctcaatactgaatatctatgctccaaatacaagggcagccacattcattaaagaaactttagtaaagctcaaagcacacattgcacctcacacaataatagtgggagacttcaacacaccactttcaccaatggacagatcatggaaacagaaactaaacagggacacactgaaactaacagaagtgatgaaacaaatggatctgacagatatctacagaacattttatcctaaaacaaaaggatataccttcttctcagcacctcatggtaccttctccaaaattgaccacataataggtcacaaaacaggcctcaacagattcaaaaatattgaaattgtcccatgtatcctatcagatcaccatgcactaaggctgattttcaataacaaaataaataatagaaaaccaacattcacatggaaactgaacaacactcttctcaatgataccttggtcaaggaaggaataaagaaagaaattaaagactttttagagtttaatgaaaatgaagccacaacgtacccaaacctttgggacacaatgaaagcatttctaagagggaaactcatagctctgagtgcctccaagaagaaacgggagagagcacatactatcagcttgacaacacatctaaaagctctagaaaaaaaaggaagcaaattcacccaagaggagtagacggcaggaaataatcaaactcaggggtgaaatcaaccaagtggaaacaagaagaactattcaaagaattaaccaaaggaggagttggttctttgagaaaatcaacaagatagataaacccttagctagactcactagagggcacagggacaaaatcctaattaacaaaatcagaaatgaaaagggagacataacaacagatcatgaagaaatccaaaacaccatcagatccttctacaaaaggctatactcaacaaaactggaaaacctggacgaaatggacaaatttctggacagataccaggtaccaaagttgaatcaggatcaagttgaccttctaaacagtcccatatcccctaaagaaatagaagcagttataaatagtctcccagccaaaaaaagcccaggaccagacgggtttagtgcagagttctatcagaccttcaaagaagatctaattccagttctgcacaaactttttcacaagatagaagtagaatgtactctacccaactcattttatgaagccactattactctgatacctaaaccacagaaagatccaacaaagatagagaacttcagaccaatttctcttatgaatatcgatgcaaaaatcctcaataaaattctcgctaaccgaatccaagaacacattaaagcaatcatccatcctgaccaagtaggttttattccagggatgcagggatggtttaatatacgaaaatctatcaatgtaatccattatataaataaactcaaagacaaaaaccacatgatcatctcgttagatgcagaaaaagcatttgacaagatccaacacccattcatgataaaagttctggaaagatcaggaattcaaggcccatacctaaacatgataaaagcaatctacagcaaaccagtagccaacatcaaagtaaatggagagaagctggaagcaatcccactaaaatcagggactagacaaggctgcccactttctccctaccttttcaacatagtacttgaagtattagccagagcaattcgacaacaaaaggagatcaagggatacaaattagaaaagaggaagtcaaaatatcactttttgcagatgatatgatagtatatataagtgaccccaaaaattccaccagagaactcctaaacctgataaacagcttcggtgaagtagctggatataaaataaactcaaagaagtcaatggcctttctctatacaaaaaataatcaggctgagaaagaaattagggaaacaacacccttctcaatagtcacaaataatataaaatatctcggcgtgactctaactaaggaagtgaaagaactgtatgataaaaacttcaagtctctgaagaaagaaattaaagaagatctcagaagatggaaggatctcacatgttcatggattggcaggatcaacattgtaaaaatggctatcttgccaaaagcaatttacagattcaatgcaatccccatcaaaattccaactcaattcttcaatgaattagaagtagcaatttgcaaattcatctggaataacaaaaaacccaggatagcaaaaactcttctcaaggataaaagaaactctggtggaatcaccatgcctgacctaaagctttactacagagcaattgtgataaaaactgcatggtactggtatagagacagacaagtagaccaatggaatagaattgaagactcagaaatgaacccacacacctatggtcacttgatcttcgacaagggagctaaaaccatccagtggaagaaagacagcatcatcaacaattggtgctggcacaactggttgttatcatgtagaagaatgcgaattgatccatacttatctccctgtactaaggtcaaatctaagtggatcaaggaacttcacttaaaaccagagacactgaaacttatagaggagaaagtggggaaaagccttgaagatatgggcacaggggaaaaattcctgaacagaacagcaatggcttgtgctgtaagatcgagaattgacaaatgggacctaatgaaactccaaagtttctgcaaggcaaaagacaccgtcaataagacaaaaagaccaccaacagattgggaaaggatctttacctatcctaaatcagataggggactaatatccaacatatataaagaactcaagaaggtggacttcagaaaatcaaataaccccattaaaaaatggggctcagaactgaacaaagaattctcacctgaggaataccgaatggcagagaagcacctgaaaaaatgttcaacatccttaatcatcagggaaatgcaaatcaaaacaaccctgagattccacctcacaccagtcagaatggctaagatcaaaaattcaggtgacagcagatgctggcgtggatgtggagaaagaggaacactcctccattgttggtgggattgcaggcttgtacaaccactctggaaatcagtctggcggttcctcagaaaactggacatagtactaccggaggatccagcaatacctctcctgggcatatatccagaagatgccccaactggtaagaaggacacatgctccactatgttcatagcagccctatttataatagccagaagctggaaagaacccagatgcccctcaacagaggaatggatacagaaaatgtggtacatctacacaatggagtgttactcagctattaaaaagaatgaatttatgaaattcctagccaaatggatggacctggagggcatcatcctgagtgaggtaacacattcacaaaggaactcacacaatatgtactcactgataagtggatattagcccaaaacctagtatacccaagatacaagatacaatttcctaaacacatgaaactcaagaagaatgaagactgaagtgtggacactatgcccctccttagaagtgggaacaaaacacccttggaaggagttacaaagacaaagtttggagctgagatgaaaggatggaccatgtagagactgccatatccagggatccaccccataatcagcatccaaacgctgacaccattgcatacactagcaagattttatcgaaaggacccagaggtagctgtctcttgtgagactatgccggggcctagcaaacacataagtggatgctcacagtcagctattggatggatcacagggcccccaatggaggagctggagaaattacccaaggagctaaagggaactgcaaccctataggtggaacaacattatgaactaaccagtaccccggagctcttgactctagctgcatatgtatcaaaagatggcctagataggccatcactggaaagagaggcccattggacacgcaaattttatatgccccagtacaggggaacgccagggccaaaaagggagagtgggtgggtaggggagtgggggtgggtgggtatgggggacttttggtatagcattggaaatgtaaatgagctaaatacctaataaaaaataaaaacaaaaaacaaaaaacaaacaacaacaacaacaaaaaacccaaaacaaacaaatctacttctaacaatctcactagactatgggggctggaaaccagggcccccttcactgttattactactttcttcttttccaacattacaagaccatgatactatttttgggaaatgtcatatggaaaattgacacctgttctgctcatatgttcccacacaggacagtttcaacagaatttgcatggcttttcccatgtcttatttcttttgttcctacttgttgatataaaagcaaagcaaagcaaagcaaagcaaagcaaagcaaagcaaagcaaagcaaagcaaagcaaagcaaagcaaagcaaaacaaaacaaaacaaaacaagcctcacgaaacagtatagtgtcactgtattagagaagatcagaatcccagccccagccacacagaagcaatgtgagtgagcctcaggcccttgctcctgctaagttcccattggtgaattcctaagtggaaccatactgtggctactgtgaaaaacacggaagcggccacacaaaaaccaccctgaagtatcaaattctgtttctttagctgtattcctaggattactggatcatgtggggattttactttaagtcagagtgtacatactgctgtgttctgctctgtaggagagaagagaagagagagagagacatagatttggtaccttgtgatctcaactttattatttttttcttaaaagtgatagcatcaaaagaacctatctttttaaacttctgtgggtctcagaacatataatgtgtgaatttacttagaaatgtggataaactattgcaattatcaggtaataattttgcctaatagaaatagagttacatacatcttagaccagatttctgagttcactcagatctcagcttgtacttgtagaacaggatatcaaaaaagctcttagaagtagaaaaagtgtgtgtgtgtgtgtttatgtatgtatgtatttgtgtgtgtgcttgtctgtgtgtttgtgtgcttgtgtatatgtgcatgtatgtgtttatgagtaggtgtgcttatgtatatgtatgcatgcatgtatacatttgtgtttttgtaaagtttgtatatttctaccatacatatacacgctagaaaatatctggactgtgttgctaagttttttgaggtaataattcctgggaagagattacttgactttctgaagctctaacatagactacgtataatttgaaaggccatgagagttagtataacttggatgcaaagacgactgtgaatataacactctttccagctctatgacataatatattccatctatttccttctgggtgcatagtcctacactggggtccttgattgcctgtgttcattaatgagtttgtgtgtctacatctggataaaaagctacggaaagacagactattgtacatgtcacacgaggaaactggggcactcctggatgttgcagggatggcaaagaggggagggataagaggtgcagaaaaaaaaaatgagaatataaatccctatcttcagttaagtggattcaatctaatctaaaagtctttcactttgctaaatatttggtataggctagtagtggagggtgtctgggccatctggagacttcaggacaaacaggatggtgaagagctaggtccctgggaagctgcagaaagagttcggctttccacagtctgtgggtacttaactgaattacacatgcactttcatgaatatgatggggtctaaatttactatattacatacgtggccatatatttatttctattgtaatttaacttaccagtaggagaagcaacacatttgttgtcttgtttactataatgtaattgttcataagaaagataatctaaattggatgtacttaaattgctgtgtgggaacagttctgccttggggggacatttgttagtctctaccagcacatcagttcaacaggttagtgatagtggtcagaattctgctatgcacaagagagacccctaagaattcctgaccccaaaccccaaaaatactagctggttttgtatgtcaacttgacacagctggagttatcacagagaaagaagcgtcccttgaggaaatgcctccatgagatctagccgtaaggcatttctcaatgtgggtggtgccatgcctggactggtagtcctgggttctataagaaagcaagctgagcaagccacacaaagcaatccagtaaggagcactcctccatggcctctgcatcagctcctgcctctaagttcctgtcctgtgtgagttcctgttccagcttcctttggtgatgaacagcaatgtggacgtgttagctcaataaaccctttcctccctaacttgcttcttgatcatgttttgtgcaggaacacaaagcctgactaagacacccaattaggcccagccgcaatcttgtgttagaacaatcacttactttacagagagaaactgagcaccaaaggggccagtgatatgtgcaaagtcgctctgagcatataagagaggtaggtcctctagtgtatttacatcgtgccatttagcttcaaagagctagtattccacatggaactgctgaaaaaccaatattgctgggaaccccttgcacttcagatatggtacataactgcacagtaaacatcagtccacagctagccatagttaggccaggcaagaagaaacagagaatttaattatgtaacacctattcagatattgtatgaaaaccattttcatatctgaccaagttactgtcccatgtactggatcttcacacacctcactactgcctggaggttgtaagaacttgcatttctagaacctacaaagggaagttctaagtgtgtctgccctgaggcccaaagacgggcatttccaaatgttccattcagatgctgacatagctagtagctagctttctcagaccactgagaaacactgcctaacatttgatggggaaatggcaaatgctggtctaagagtaaacttgaatctcacccttcatgtaatctcactttaagagtgattaatgttaattcacacaaaggactataatcatataagtggtaatttagacataattcaaatttcaaaaagtctaaaaaggaagaaatctgtaggtttttgatagcctatagagacaacattaaggaataatcatatgttatttgaggagaagagtgataccctaaatataataagtattatataaaaatattatatataaaataccctaaattggaagacatccaaacaaataatataaatattattctgtatgcattctttatttttaacattttatttctgctagactgagtgaccttgatctattgggcctgccgagctgtatctacggggatcgttgctattgacatcagtaatataaaatcaggcctttagggagccgtaactgtctcttcaaatgatttgggaaaatgtgtacatcttcaatcaattaaatacaggacaaatttagtcaatcacaaatgatcaacacgcccctgttcattgtgcttagcagtatgaaaatggcacccaggcaaattgatttcggtaacactccttttcattcttttaattcaatagtgagaagaatataaggcagttttcaatgttctatccacagtaatcctgtagttagtctgccttactgcttacaccagagctcatttgaagacacccaagcaaatgacaggaaacttttaactctggtcaagtcccaatcacagacccttgcttgccaaggacacaaaggaagccaaactttcaaacatgctgcattgatctccaactttttaaatccctctgtcattttaaatgaggtgcactcggttgtgtcatcatctcggttttaattgtgtgaaaatttcctgccaatctcacaccgctgcggcaacctcaccttgctacttgccctgcaagttctgcagtgtgccgttctgagtatgccgttttaactagttcttgcagcaggacacaaagcgagatagtctgatagaaccagttctcctctggttttacctttactcttagatgagttaagggtcacatcaaaccagggctcagcccgccagatctcctaagcacagcccctcctgacccaatgcagttaacccaacctcattcagcgctagtatcaaatgacactggagctgctgcagtatgcatcccgagactaagtaggcaggatttattatcagcagaagtcccctaactaccaggttattcaagctccgttcttgtcacaaacaggcgcggcggaagacacagtgcagcagactcagagctcatttacaagacaagcgaattctcagttagagacaagggcagcgcggcagcgaactgcagtaaatcttttcacgctcacagcaacatctaacaatgctctcctgcaacgcctcagatcaaacgaatcctacttggtttaaacatcaaatcaacaccataaaaaaggcttcattagcaaagttcaatttaggatgtttttaatcgtgtcttaattctagaaccagtgcgagactttccatgcttattcaagcatgctgacagaattggaacctcttagaattgcctacctgcacctatcagcctggctgacaggagcccgccaaaggattaaaaaaaaacaaaacccaaaacataaaatcatgcaaaaaaatatttacccccgaaagatgtatgtagttaaagctcagcttcctgcagcctcgatagcccctgaagtgttaatctgaagaaacagttccatgagtttccacaggccggtagtgagtctcctacacttgacctagacagacttacat

SEQ ID NO: 12 - RNA, 170057 nt, Mus musculus
uaaaauaaaaaauuaauuuuauuagauuugcacauuuuuuaauugugauuagcaucauuuugggcuaauaguagcauuuuccaacaugcaguucaugaauacgguuugccuaaauauuuuuuuuuuaagaaaaagaggugccuacggucugcuucuguaagaaacacaaauaucuugauguaauugacuauauaaguguaauccucucugauuuugaggaaaagaaauucugaagcccacauuuauauuuagaacaaucuaaagaagcaugauuucaaagcaaagaaaaauaaacagaaauuggggaaauaaagaaaaaaaugagaaaaaaaagcacucuggucaucuguuagcacaaacacuacaauaaauauaaaucaaauguuauaccuuuuccaauugcaaaucauaauuuggaugugaaguugugaguguauuuugccccuuaaaauuaugaaauaauccaaaauuaacaauuguaauaaaaaagcagagaucuaccacuacccagucauaguuucauuucuuaguuagcaaauaucuuccaugaaaaacugcuguggacagaaaguaagaaaagugauugugauaucaaccugaagauaauuuccucuucauauguacauaaugcugaaaaguaaaagaaagugacuuuguacaguauuuauauuugcuuauaaaacucuaaacauguuuuuaacagguuaagcaguaguguugucuuuugaacacguauguacagucuggcuauacauugaacguuauccacuuaaauuuuaaaaacaacccaaacauuguuaaagugcugcaaacuauugcuuaaugacuuaaagaaaugaagucugcugaacaguuuccuugacuuagccacugaccuaugguuucucgugagugagauucugagugcugagagaaacuagauaccgcaacgugguaauaucgacaugcauuggcagcauccacacuaucuacaaugguacagaguacaguauauuuccgguggacagcuugcacucuacauuucucgugguacauauuugaugcaauaaauacugugcuuacgucauuauuuguuugcucaaacgugcaccacagaguaaaaugacuauuuacauaauaaauagcauuucauuaacacauacagugucaaccuugcugagagcugaagauggcuaaacaaagugcaggaggaagcggggauuuauaaaggguucuuuuggucaauucgcucugcuaggguuggggguagggagucagagucauaauuuagagaccuuucagagacagugaacagaaauguagcgugacuccagacauuugaaugaaguuugcaccuccuaagacuugaugaccugucugaacaaucuccuuggacuaaggacuagauuuugacaaacccagcucagcaaagcccacgaucuagcgaucaccuccguaccgcccccuccccccgcagaaacacagaugacauagaacuguugaagaacugucuuugcuuuccuuucgacuuuuucucaugcaugauccuaaggugcaacaugcccucaugcgaaaccacaccguugugcagacgggagggccauaaggaugucaacacucccaggugacacaccgggaaaagaguuccuuuagucuauuucccaacagaaacccugcuuacaaaaauagucacauguaacaaacaacacauggauuaaaaaaaagaugaauccacuaacagaguuuguaaaaaaccugacaaauguggcaguugaaaugcaaacgguggauagaguuacuacacuaaaguguuucacauuaacccccaaauuauagcucugcaccccuuuagacugaucccuacagucugcauagccauuugucucuugucuucagcagugucagcugguaguuagaacaguacccuccugucaagguuaucuccccuuuacacagucacagaguuugccgacaagggggucacugucuuauugaggcacugaccuuaaagugaauuuguguaaaaacagucaguuuggcauugacuucuuaaaggaguccuuuugacuucacaggcuguaaacaauuugucacccaauuuauuauuuuuuuuuguuguuuuuguucauuucccuuuggcuuuuucauccuucccuuccugcucguguuucuccacgauuggcuuugucacccgaucguaggagggcggacaagcugcuguggacauugucaggucaguuuucuccguaauagaguuuucguuuauucugucaaugagcaugucuucuuuuacaagaagauuagccccaccuuugaguuuguucuuauuguaugugaaugaagcuuguuuuacuguucgcuucaaaagguggcgccuauaagcucgcugaaugauaacagcugacaccuccucuuguuugcguuuuaauguaguagugaugggcugauaagagaccuuggagggguuggaagccaugaaccgcucuuccaucuggauucgaagagcauccaucucuccacucucacccaacacccgcuuuguaaaagcaaauaagauguccaggcaguggaugcggucuccacucaccaugggcagguccauggcaaugagcugaaguuuguuugguuguggcaaauugagaggggguucuagagcagcugcaaacugagauaauuuuucaaauuccaugaacuggguggcgucagggucgaacuucucccagaccucguagaacaucucaaagucguccucacucagaggcucugcacuuucuucuguggcaacgcugaaguucuccaggaugacagcaauguacauguucaccacaaccaggaaggauaugaugauguagcugacaaaaaagaaaauccccacagauggguucccacagucucccuucaccgagcuuccaggguuaacuuuauuagggucacagucaggggguuugcuguugaggaugggggccagcaguccaucccagcccgcagagguggugauuuggaacaggcagaucaugcuguugccgaaggucucaaaguugaacaugucaucaaucccaacuucccucuuaacauaggcaaaguuggacaucccaaagauggcguagaugaacaugacgagaaaaagcaggaggccgauguuaaacagcgcaggaagggacaucaucagagcaaagagcagcgugcggauccccuuggcaccuuugaucaggcguaggauucguccaauccuggccaggcggaugacucggaacaggguaggagacacaaaauacuuuucuauuagcuccgcaagaaacaucccugugggaagauaauuaaacuaucaaucagugaagaagucaucaacuaaucauuuauuaaaauauuugaguuauuaaaguuccaaugucaauuucagaguauuaagauucaauuuuguaaucuuggguaugguacaaauauauuccaaucauuuuccaguaucugcagcugauuugucccaggaugcaccucuccuccuuagaacaucaaaauucaaggacugaaagcccuuuauaucauauggcagcacauuugcauacaauuugucuauaccauuuuauugaaaguuuugaauuauauuuaaaauguucaucacauuuaacaaugaaaguaccaugugaagaguugcugugauauuccagaaauccaauccuaacuaaacaacaacaacaacaacaacaacaaaaaccaaguaaggcugaguggagguggaucccaguacucaaaggcagagggaggggaucucuguuagugugaugguagccuggucuacagaacgaguuucaggacagccaaggcuacauagaggaacccugacuugaaaaaccaaaccaaauuaaaaccaaccaaccaaccaaccaaccaaccaaccaaccaaccaacaagaaaacaaacaaacaaacaaacaaacaaaaacaaaaaauccaaaacagaacaguugcuaccguucauuauauuaaaaauggucaggagaggagcaugguucuuaaaaauacuuuugaucuguguuugaauuuucagauauuuaauacauacauauggaaaacugaguguuuauagaauuauacgauguauaauaaaaguuaacuuuagcuuuuacucagccucagcaauagauuaaaauuuaagaaucauaguacagcucgcccccccaagagcauuuauuuauuuauuuauuuauuuauuuauuuauuuauuuauuuuugguuuuucgagacaggguuuuucuguguagcucuagcuguccuggaacucagucuagaccaggcuggccuagaacucagaaaucugccugccucugccucccaagugcugggauuaaaggcauguaccaccacgccuggcccgaagaguauugauaugcuaugguuaacuuaaaaucucaucagaaauaaauacgaaaauuugcuucaaugucaacagccaacaauauaugaauaugauguuuuuucucuaaacuuguugaaccaaacuuuucuuuuucacacuucacuaaucugaagucuuggaguguuucaugcuguuuucauccucauaugaacuaauauuauuacagaauuguccgugcaugugccuguguguuugcaaaacacuccaggguugauguucuuuuccucuccuguagcaaaaucucaauuuuuuaauuuuuacagcuuuuuuucucccugugauuuuggguuuuuuggcacauguauguucauguggcaugugcucucucucucucucucucucucucucucucucucucucucucucgugagugugugugugugugugugugugugugugugugugugugugugugugucuuaccugaggcugaugcugggagucucuuugauugcuuucuacuuuauguauuuauuuucaauuuuuaaaauuuuuauugguuauuuuauuuauuuacauuucaaauguuaucccccuucucauuuuccccucccaaacccccugccucuauaaggguguucccccaccaucccaucaacucccaccucagggcccuagcauuucuuuugcggggucaucgagccaucacaggaccaagggccucccuuuccauugaugaaugacaaggccauccucugcuacauauguggcuggagccaugcuccauguguacucuuugguuggugguuuaggcccugggagcucugggagcuuugggagcucugguugguugauauuguuguuccuccugugggguugcaaaccccuucagcuccuucaguccuugcccuaacuccuccauugcagucucugugcucaggacuucucaauugaacacagagcucucugguagcuugccagauaauuugagggguuccaagagccuucuuuauaaggugucacccuuggccaggauuuacacuggugcugggaaucuguucucucguucucaagcuugcacacuaagugcuuuagaugccacugcauuucucagcuccccccucuguccuuuaaauaaagacuccauuaaagaguacuuccaacacaaacacacacacacaccaccaccaccaccaccaccacuaccaucaccaccacuaucaccaccaccaccaucaucaccaccaccaccaucaccaccaccacugccaacagcaauaacaacaacaaaaaccuaccuauucaaccaaccaaaauacccaaaugcaucauuguaugcaaagcacaaaagcaucauucucuuuagucagccuucucuaucucagucucuaucucugucucuuucggccucucucuuuuugaugcuauuuacaugauuauuguuggaauuaaaaauuacauauaacauauggguuggauuuuagauguaaggccuauuuauucagaggggggaauagcacacagaucauuccaacugaguccuaugcuugaaaauuugcaaugauuucaucuuaauuaggaaugaaguucccauacagggacuucuucacuucucugaagcauuguugguaucugcagugagaugaguuaccuucaugaggcucuuauguacuacacaauuuguaggauaggacuaagaaagagauguuccaugcuaccaguuuccuucuggaaauauugaaaauuucuguaugaaagccacaagaaacuacuguuagucuacuugcauuucccauuuacuucuauccauguucuacucugcaugcuggugaccccauuaacuacaucucuaauguaaugucuuuccugaccuucagaccagauucucaguaccccucuuaccagaaucaucuagaucaguggaucuaaaccuuccuaaugcugcaacccuuuaauacaguuucucauauuguggugaccaccaaucauaaaguuauuuuguugcuucuuaauaauuguaacuuugcuacugcuaugaaucuuaaugcaaauaccuaugauuucuaauggucuuaggugaccccuaugaaagggcuauucaauccccaaaguguugcgaccuacagauugagaaucauugaucuggauagcguauagaguguuuaaucucaaccaccuaaaagcacuuuuuaaauuuugguucaccacaucaaucuauuuaauauaucucaauaaaggagaucuuauuaauggucaaauaaauaugugaugcaaugggauaaaauauuuguauaaauuagaagccuaauuuuggaagaaaaacaaauacaacucaaaaacacaugccaacauauugacuuugaguagugagaugccuuccacucuaaauuccuguuuucaaccuccacuuuuaucaggaggaauuugccagacuuugcacagaucuuaccuacaauggagaggaugaccaccacaaaaucgaaaauguuccauccaauggugaaauaauaauggcggagcgagaugagcuugagcacacacucgccggugaacaggacgaugaacaccagguugaugcgugacaaaaugcuugucacauaaucgcucuggucauccguuuccaccaucauggucaccauguucagacagaugaggaucaugaugcugauaucaaacacuugucugguuacaaagucaaaaaccauuccuugaaauuuguucugcagagaaacaaagacacuuucagcaaugcgggagauuccugguagacagcauauacauuaaauacuuccuauauucccuacuuucuaguauuguacauaguaccuaccuauugggacaaauauuuguaauuggugccuuguagaacauuuuuauaucuaguuaauuaaauuuuuguuuugaggcaugcauauuccugaauacaucaaucccuugcuguagauucuuucccugcacacucuuuacagaaacacacagugaauuucaacacaucaagguuacagaacuguaagaaaucuguuugauuugcuguugccaaacuuuggcucacuggcuguaguacuuuccaaugagcagcuagacaauguggucauuuauaaacguaauaaauauuagucuuaaauuugcuuuguuccuagagaauuaucaaaggaaccuugugauuucaaggaugcaucugaaacaccaaacauuuacauuccugcugggcaaguagcacuugggggguagaggcagguggauuucugagccagccuggucuacaaagggaauuccaggucagucagggcuacacagagagacccugucucaaagaguaaaauaaaauaaaauaaaauaaauuuacauuucaccuugacaacauuaauuuguucccagcaaguggucuuugcugauauugucagacaaauaaugaugagucuccacagggguaaucagacugaaaagacauugcuugcuaugcuauaacaaagggagcacauguccuucgcuacucauguguagucagcugagguuaggcccaguacaccaucuucugcuuauuucuuugggccacugaagaauccuaagcauauuuuaguaccauaaaauaccccugcugugcaguacuugacuuguguagcacuaaguaucaauggggaaaauguucucauuagacacuuugccucuucuuagaacugggaacaaaacacccauggaaggaguuacagagacaaaguuuggagcugugacgaaaggauggaccaucuagagacugacauaucuggggauccaucccauaaucagcuuccaaacacugacaccauugcacacacuagcaagauuuugcugaaaggacccagauagagcucucucuugugagacuaugccggggccuagcaaacacagaaguggaugcucacagucagcuauuggauggaucacagggcccccaauggaggagcuggagaaauuacccaaggagcuaaagggaacugcaacccuauagguggaacaacauuaugaacuaaccaguaccccggagcucuugucucuagcugcauauguaugaaaagauggccuagucggccaucacuggaaagagaggcccauuggacaggcaaacuuuauaugccccaguacaggggaaugccagggccaaaaagugggaauggguggguaggggaguggggggggguaugggggacuuuugguauagcauuggaaauguaaaugaggaaaauaccuaauaaaaauauuaaaaaaagaaagaaagaaaguagugcuugaacuggacaguaguagagcaugcuuuuaaucccagcacuggggaagcagaggcagguggaucugaguucaagaccagccugaucuacagugugaguuccacaacagccaaaacuccaaagaaaaacccugccuccaaacaaacaaacaaacaaacaaacaaacaaacaaaauuggcuaguacaauagaaacauucacuaagauucuguuuuguaauucaucauggggaauauuuuaagcuuaagaucacugccauagucaaggacaccacaagaagaccuacagugucaacuauccugggaccguggagacucacaaagccugggccaccauccagggagcgugguggagcuggaucuagguacccuacacauuuguagcaagugugcagcuugucuucauguggguucccuaacaagcugucucagucucugcuuccugucacuggagcccccuccucuuaccuagacugccagguuaguccuuggugggagaggaugugucuaguucugaugggacuagaugucccaugguggagugguauaaaagggggauccccuucuuugaggacaaggggaggggacaauaggaagaaggauuuguugugauggugggacuaggaagagaggagggagggaggcugugauugggauauaaugugaauaaaagaaauaaguuauggaaaaaaaucacugucauaaaaauaaccaugauaagggcucuuucuccuuuauaguuuguagaugaaucuuggaaauaugagaaugguuauuuauuaucacaaauuguaauaaugccgacauaagcaauugcugauuuuagagccauacaaaaacauauucauuacugggaugcucaccuccucuaaaaugguccauauuucuacuuauuaaacaacaauuacaaguggagaugauaugccauugagcaucuuuucuaccucuuuaaucagaaaguaaaugaauauuagccccacccuaugcuucuguauugcuugacauugcacugcagcuacuguaaagucauaaagacacaacuauugugaggaccacauuagucuacguaguuuggauucuaaguguguaguuguaggucauuuggagacaaauuugcauuuucuguauauucuuauucuuuuuggucuuuaaaaaaaauaucaaaacauagauuagagauacucaaaagguuuuuuuuuuccuuuuucuuuuuucuuuuuucuuuuuucuuuugugcugggaaugguaguugauuuccccugagaaacaaaacucauuucagguuguugcuuuauauuauuuucauuugauauuucuuacuccaggucgagggauaggcuuuuguggcuuuuuugauccuaauuucuucauugcauuauaguauuucuucuguucuucugucauaaagaugucuugaccuccaaaguauagaaaaaaaaaucaaagcugguuaaaauuguauccauucccucauaacuuuucaauauuauaacaagagauuucaagagauuaacaugguuauccuugugacuuauuuugaauuugaaaauuaaaaguacacuguauugacuauaauacuuaaguuuuaagauaacuaaaauuggcauuauuauuauaauuauugaaggaaaaaagcccagacaugguaaaacacaaagcuccaucuuccuucuggcccacacuuccaccuacagucagggaccagcacccugagcucuccuucacaaccugucugccucaugggaguucuucucccaccagaacaaccagcuccauguuucaguccacaccucuaccugcaauuggggaucuauacccuacaccucagccaacagcucugcuugccucuggggagggcuuuagcuaucuaggacaacaagucucugagaguuacuacucccaaggacuuacaggccagccaacaccagagaaaaaaauagauggcgaaaggcaagcucaauagaacaauagaauaaucgcuagaagccagugcaguauggcaccuucagaacugagcucucuuacuacagcaagcccuggauauccuaacacaccugaagagcaauacuugaccuuaaaucccaucuuaugaagacaauagaggccauuaaagaugauauaaauaaagcauaugcagaauauaggaaaauacaacuaaacagguagaaaucuuuaaugaggaaacaaauaaauccccuaaagaaauaugaaaaauacaaucaaacgggugaaagaaaugaauaaaauggacucagauuuaaaaauagaauuagaagcauuaaagaaaacacaaauggaagcaacccuggagauauaaaacugaggaaagagagcagggacuacacacauaagaaucaccaacaaaauacaagagauggaagaaagaaucucagacagaggaaaugcaauagaaaaaaauuaauacauugauaaaggaaaaugccaaaugaaaaaaguucccaacucaaaacauucaugaaguugugauacgaugaaaagacuaaaccuaagaauaauagaaauaaaagaaggugaagauucccaguucaaagggcuaaaaaauaucuuaaacaaaacuauagaagacaacuuuccuaaccuaaagaaagggaucacuauagaagcuuacagaacaucauuagauuggaccagacaagaaaauuuuccuuccacauauuaaaacacuaaauauauagaauaaaagauagaauauuaaaaacuacaagggaaaagggccaaguaacauauaaaagcauaccuaauagaauuauaccugacuucccaacgaaccucuaaaagucagaagaucuugcagaugcuaagagacuacagauagcagcccagacuauuauacccaguaaaacuuucagucaucauagaugaagaaaccaagauauucuaugacaaacccaaauuuaaagagaaucuuucuacuaauacauccuauaauggauacuagaagaaaaacuccaacacaagaagaguaacuacacccaagaaagcacaagaaauuaaucaucuuacaguaaaaccaaaagaagagaaucacacacacacagaaccaccacuaacaucaaaauaagaggaacuaacaaucauuggucauugauaaauuugaguaucaguagacucaauucaccaauaaaaagacaggcuaacagacacguaaacaauuuccaucauuuuguggcauacaagaaacacaccucagcaacaaaaaaagacacuaccucagaauaaaggccucaaaaaaaguuuuccaagcaaaugaacccaagaaaccagcuggaguagcuauuuuaauagcuaauaaaauagacuuucaaccaaaauuggcaaaagagauggggaaggacacuucauacucaucaaagggagaauccacuaagaugacaucucaauucugaacagcuaugccccagaagcaaggaaacucacauuuguaaaaggaacuuuacuaaggcucaaaucacacauugaacccuacacaauaauaguaggaaaugucaacaucccacuuucaccaauggacaggucauugaaacagaaacuaaacagagaaucaaugaaacuaacagaaguuaugaaccaaaugaauuuaacagauaucuaaauaaccaccccaaaaccaaagaauguggcuucuacucagcacuucaugagcauuuucuaaagcugaccauauaauugggcacaaagcaagccucaacagauacaagaagauucauauuaccccuugcauuguaucaggucaccagggauuaaggcuagacuuaaaaaaaaaaaagaacaacaacaacaacaacaacaacaacaacaacaacaaaaacccagaaauaacagaaagcccauaaacuuauggaaacugaauaacucuauacucaaugaucacuaacuuggucaggaagaaauagagacagauaccaggugccaaaguuaaaucaggauaagaauaaccaucuacacauuccuauaaccccuaaggaaauagaagcaggcauuaaacuucucccaaccaaaaaaaguacagggucagaugguuuuagugcagaauucuaccagaauaccaaugcuccucaaacuauuccacaauauagaaacagaggaaacacuaccuaguucacucuauguggccacagucacucugauacuugaauuacacaaagacucaacaaagaaagaaaacuacagaaccauuuugucaaugaaaauugauacaaaaauaaucaauaaaauucucccagacccaauucaagaacacaucaaaaacaucaucaccaugaucauauaggcuucauaccagugaugcagggaugguucaauauguaggaauccaucaguguaauacuaguacuccccaaauucuuccaaaaauagaaacagaagaaacacuaccuaauuaauucuaugaggccacaguaacccugauaccuaaaccacagaaagacucaacaaaggaagaaaacuucagaccaauuucacuuaugaacaucuacgcaaaaaacacucauaaaauauucacaaaccaaauugaagaacacgucaaacacauaauucacuacaaccaaguaggccuuucaucacagggauacagggaugguucaauauaugaaagaaaaucuaucaaugcaauccacuauacaaacaaacugaaagaaaaaaaucacaugaucaucacauuagaugcugagaaaaccuuugacaaauccaauacuccuuuauguuaaucauaauaaauaaaaaaugaaugcaacgaacaaauaguaugaaaucaugggacauaaagaaauauaauuggcugggaugaacuuggauacauccaaaacuauuugccauaaaaugcacaaaaaauaaaguuaaauuuuguuucccuuuaagagaugucaaauauuaacaacuaaagggaaugucuggugucugugagagugguggagcaaggucaugcucacauagcuuauucaguugacuaguuauuuaacuacaaggaggcaauauacuucacucuggaauuuaauguaagaaaagauuuaaacacucaaauguuuugcaggaaaaaauuacuuaagucacuaaagauuagauagauugaaauuggccaaguuaugauaaauaaacaugaacacuuuuaacaaacugagaaaucucugugauaaaaguauuuaaaauuguacauugggaaacauuucagggcugggaccauggcuuagugcauauaggcauuugcuuacaauccaaaucaccuggauucaaucccugggacucaaaggguggaaggagggagaccauauccuguaaguugucuacugacuaccacacacccaguguggcaugaauaaauaacuguaauuuuaaaaaguauuucagagauggcugaagugauaaauuuauuacacauuggcgugaauauaagcucagaucccaacccccauguuaaagugggcauggcacuauguuauuaaaacaaaaaccaaauggugauggggaugcagagauaagaugaauccauuaaucucacuggccagccaucaaucugaauugaagaggagauucaaugagaacuccugucuuaaaaauuaugguggguagugauugagaaaggugacuaauguuuaucacuggcuuuuacaugcauguguacauucauccucacagacacuugcacacaccaccacgaauacacauacaacacaacacaauacaacaacacacacacaacacacacacacacacacacacacacacacacacacacacacacacacacacagagccacauauguacacagaauauuucagggucagacaacgugauaugugacuauaguuccaauuuauuugagaaggauacagggcugcuacuuguuuuaggucacauagggccauauagugagaucaggucagccuagauugaaaagugagaccaucuuaaaagaaaaaaacagaugagaaguaguucaaaaaaggagacuguucauggaaagaguuugagcagacaaagaugaaauguggaccauuguuacuacugagugauaauauuugcaugcuuccuuuagugcacauauauaauugaaauaaucaaacaugccuuaagaaugauaauagauaaaacaaaaauuccucaaauuagaacuagaagugguugcuauuaauuaaauaaccagaagaaagaaguacagguagaaaagaguacaaaagaaguauauacacugaaccguauuuuaaaugauggauaauuacugacuauguauaaucaugggauuuagugugauauuguaguacagacaugccaguguucucugaucaaaucuaaccccuuuucccucaccuuuccacaugcuuuuccagccucuagugaucuuuuagcugcgaauaccuuauaaaggggagugagugaggaguuauuaaggauaaaacauagggaaaaggucgugagcuauuugguuucugaauucaagaucucaucuugaauuccaauucaaauagaauguuaauuacucugauuccuuguguuaggaaaaauuguaaaaauacuuaucuucuucuuuugcugguugaaauugucgauaaugacaccaauaaacagguucaggguaaagaaggacccgaagaugaugaagaugacgaaguacaaauacauguacaggcuuuccucauacuuaggcuguaguucaaccugccaacggagggaauuuguuaacugauaaagcaguuugaauacugggagcaagucggugcuucuacacaagaguagaaggcuauauauauucuuagaaauaauuuaguguauuuuauucccauaucaacagccucaaagaaacaaaaaaccaaaaaccauccuugaaacuaggaagcaaaaaguuuuuguguaaaaagugaugcaauucgucacucuaacacuaauugcauaauuuuacauaguauaacugacauucuguuauuuggauaauagacuuuagauuugguaaguuuuaaguuaauugauuuucaguaauuugaaaauacuaguguggugucuuaugucugugcaacuccagaauuugggaagcugaggcuggagacuuguugaguacuauucuagccugggccacaaugcaacauccugucuuuaaaacaaccaaagaaaaaguuagugaaaaauuagcucuuauaaauauagagaggacacuuuuauagucaagauucacuuguguaugaacuuauauagcaaaugaaggaacugaaguauucauuuggaugcuggcaucuugcccuaccaguaacaaagucauuaaaauuuuuggauugaauagacacguucaaugauuuauuuuauaaaauccuccauugacgacugacucucagacuugcaguuauaaaaauagacacagggcugucacucaaugcauaacaauggagucaauauuuaguauaaauagguaacuacugcagucuucuauuuuuaaagacaacagcuaaaauuaacugaacaucuaagacaaacucuaugcaacaaggugagaugaugcaauuccagaggugaucaagaaguuuguaggggaacaggacgauuucaaauuuaucauugucuccauaguaagcuagaggucuggguuaccgaagaaaaccaaaacaagaacaagaauaaaaaaacaaaaacaaaaaacaaaaaacaaccaaguaacaggaaagaagaaaacagagauuuuacaguuuuggagaucaaucuuagaggaagccugugauuuuugaguacaucugaaagcuaggaaaaguauggaaucaauaaaguagaaaugauaacaguguugguacauaggaaagcuaggaaaaguauggaaucaauaaaguagaagugauaacaguguugguacaucugaaagcuaagaaaaguauggaauuaaaaaguagaagugauaacaguguugguacacacuccagugaaugcaugggugcuguucuuauaaaggauggauuuagaaaagacuaugacacauuucuaagauguuuagccugcaucuuuagccuuucaggcuucaaagcauggagccugccuacacaguucagcuacugaagacagucauauauucuucuauguccuuuauacaacaaauagaaacacuuuggagaauaucuguugcuuauuaaaugaaagaguugaauuuuuucuuucauuuuuugacuuccauuuuuuuuucugaacucaguacaauaucucugauagacacugcuguguuaaguacaaacucaauauacugucuuccuauuuuuuaauuaacuaaaauggaguuaguuuguuuggcuaauucauaagcuaauuuaagcaccaaaucaauauuuccagaagacauuggauauaaaaaauacuuacauuucuggaaucaacugcagcauacaugauauccauccagcccuuaaauguggccuguuggaaaggacaugcaugccuuaauuuggguuaaauuucaaaacugaugcuuacuaauauccuuacuguacauguuuaaagaaauauuuuaaacuauuuucaaaacaaacuuuccuuggauuuugaaaaaaagauagaaagccaacaaaauggcgaucugauauaacuuccuauuuuccaaccagcucuaaaguaacucucaagcuuaacauucuauuacaauuuggaagaaaguccuagaaauguaaguggacuuggcagugucuacagcaagaacaaauuagaucugcgauauucugugggaaucucgucuucuaggugaucaaguugacaguauuuaagguuuuucuuuaugcuuacaguguauggaucauaugggcauaaagaaaaaaccugaagcuauucuuuuaagaauuuuucagaaauaacacuauauucauuuucuaugggguaaccccugaaaagauuguguaaauauaauuaacaacauaauaaaagugugacaaaauaggacugacacuugucauuugcacauugaugagggauuccuccucuaaccucuugcaggcauuugucaugugucuuagaacacaaguuugaggcuacaggaccugaaauauauauuccauagucaaugaggaagccucgcauauuuuugugauuuaucuuuguauuuaaaucauugacucuuggaaaaugugggagugugaccagagacuaauguaucuuagucagaaaacggaaauucuuuucacaucaaagagagagaugggugaugugucaguggcuuagaccaauuauagaaccugucuaucacacacuuccuacaggaacagaaaagugauuugaccuauuucuaugaacuuacucaucaacagagaggugggcgaaauagucaagugugaaauuuuuacuuaguagcagaacauguuugagaguucugugcacuuaucuggauucacaaauuuguacuaacagaugauaaugcugaaaacauauuauaaaguuucuuccuaacaaaauaacagcugcaauaaucacuuuguuauuauucugagcaauaaaaauuuucagagaaaauaguguucacuuacaacuugaagcaaagaaagauacccaaauccuacauuaucaaaguuuacuuucacauuuuuccaccgggcggucucauuucuuucuauuaguuuuaggcaaucagaaugauuauugacuucgcugaucucaaauaugucaccaguugugguguuaacacagugguagaauuugccagcaaacaaauuuacgcccaugaugcugaaaauuagccagaauauaaggcaaaccagaagcacauucaugauggauggaauugcuccuaacagggcauucacaaccaccuaauacacaaauggagagaaagagaagucagaauccuuauugauuaaaagcaaaaagacaucccccuaggaaucauugauuuauuuucuaucaagacuacuuauccuaucuguguaagagcaaagcagaaauaaucuuaacauaaaacucagucuuuuuuaaauauuaugcuuaggaaaagaaauauaggcaauaugcaaagagauggagaaaagaaagaaaucuaauauaaaaaaggugcuaaaggaaaagcaaaaugggagaaguuagcuccuggaugaagacacauguguaguuuauuagaaaaaauaaaaggaggagagagaaguaggaacuccuaggcaagagauuagcucauaaaaaaaaaucccaaaacaaaacaguaucucaaagaauagaacuaaaacauuugggcaugaauugauuggaccaauauacuuuaaauauaaauuaaaauucagauguauaaauauaaaacuauuuuuaacaucuaauauauuuuuggccuuaauuauccaugcauugcuauaacuaauaguaguuuuugcauaagaagcaagacaauuuagcaucauguauuucaguagaucaucacaucguuuauuucaagcuccagucaugucaguuguuucauuuacugaguuuaauucaauaaacuuaucuuaaaugaaacacuagagagaucauuuucucaggaaaacaggaaaaagagggaugucauacguacuuaucaacucugaugugacugaguaaaguccugugcuaaaauauuuucuccauuuucuaaugucaaagauauuucccucucucuuguccuuaauucgggacuacagauuuaaaaugggauuuuuuuuuuuuauauuugacauaugguagucuuggcuuccuucucuauagcucaccauugaacugcacauuaguaacuaagagggagauaaaggcuggcccuaaugugcucuuaauuggcaaguguguuucagacuugaacauggacgucagauuaauucuacucauguugggggagggggggccugccacuuuuguuaguuuaauuaugaauaucaucucuuugauuuuuauuauaguauaauuuuagaaguuuuugccugucugacagaaguauaagagccaauuccuuguacuucugagcccuggcugaacuuuguaaggaacaauauccauuggggaauacaaaauagugggcuauguggccaagggaaaugaaaccaguaacaauaaagaugagggaugaacaugaagaagauaauucagagugcgcuaucaaggcagaagccaaagauaggcugauguguagaaauuaaugagcaacuaucucccuuuauggccucccuaaaaaauuagcacacaggcuuuccuguauauauuacuuuuuaaaguuauuuucaauuuaauuuuuaaauuauuaagaagagauuuaaaaacauuuuaauguaauuuuuuaaaaaauuguaccccuaaaguuguuuauuggauuugagauaugaacacugaaauugaguaguuguuucucauuucugaauacuucaucucccacucacagugaggugcucugucugccgaggauaugaaauccauacuaacaugcaagcuuuucacuuuuaacacucaugacacugaacauuuugguacaagucuguagguuucaugcugcuuccuucaaaccuuuccaccuuggccauuggcccuguucucuaucuucgcucuguccucgguuacuaagaauuacauucuuaucagauuuuauuugcuugccuucuuucaguauggauacuaaauuuaucuaucccaugucccauuuugaaaaauuccuuaaugguucucuagccauuagaaaacauuucucuuucuuuggcauuuacaucacucgacaguuugugagguuauuuuccucaaaacaguuugcaacuauguuuauuugugugugcaugugggcaugcaugcauuuucuauagcacuuggguggaggucacaggaaaauuugcaggaauuauuccucuccuuuccaccauguggggucaguucuggggauugugcucaggugcuagacuuggcugcugaaggauucucacaagccugauacauuuccccuuucagcuucccuaacuggugacauacacuucacccuccucugugacagucacuccacgcuaagguguuagucugagaauugagagccuucuuucuuugaaacucccugccaaguacuugcccuugaaauaaucucccuccuccaggcuuuagcucaaauauacaugucguuuauugagucuaacucuacacauccuuaacaaagaugagaguguuugccuucgaauugaggaauuauaauuuaguacuggaaagagcaauaaggacaauuuggugcuugggguucauuuggaaaauuagacuaaugaagguaaaacaaguuagguucagaaaguagaccagaauuggcaucucauacucuuuucuguuuauccugcaaguuuuuucaagaguuucaaccucuuaugguuuucucugacugcucugugugaaaguuaaauauuuucuuauauuccaauuguuagauuaugaugcuucaaugugucaaguguacauaugugugcaagugugcaugcacauaugugagcauauauguggaagcauagagcuguaugggaaauacauguauagauguagaggaaagagauguaggggucggggggggggauucuuucuuauuuauugcaccaacugaauucagagcuugaggacagggcuaguuucaucuuucuagcucuggaauuacauguaagcuacuaugcccauccgacauuucugaggguucuggauauccaaauuccaguccucauacuugccuggcuaaggauuuaaccacugcauaagaaagcaguuugcauaauguaauaaaugggagagauuuccuuugaagaagggacugguuuugaauuaaaaguaaugcccauuagugaauucaggauggcaaauacuauauaggaaugcaguucaggaaaacgugcaaauuugccauagauuuggcccagugagacauuuauuuuacaaggauguuugucuuagagaacauuuggcauaggaucagaggauuugccacugaaaauccacuuaaaguugcgauuucauuaacauccagagcaaaagaucacaaacggauugccucucccaagagcccaaccaucccuugguucuacaauauuaauucuuugcagucucuagggagagucaguaauuggcucccaugugggaugcgcugggaaguguuggucuaagucaauuggaaagaacacauugagguuauaagguacauaaaaggagaugucuaagagagaaguaugcuuaauggguggauuguagagguugucucuucuaacaauguuuuaaaaggacaucucccagcagaauuucuguauugucacacaaccaguucuucaagucuauuucuucuuuaggguucauacuuuuuauuaaaucagugaaaaauuaggaccaggcaaauauucuuguugauauuagaaauuucagugcauuugaaaguaucaucuaagugaagacauuuagauuaguuuuuuaagucaccggaaaccauggguucuauagcuuuucuaagaaauagagaaaaaccauaugugaauaagaauuuaaaaaauggaaaguaaaaaucaugaguucuuaauaugaaauauaaaaaauuuuuagaaaagccaacaacuaaaucaguguugugaaauuuuauuaagauaaauauuuuugauagauaaaugccucaauuauccaaacaauuuuuuuuucuuccaaacaauaaaaauuaucuuucuuauccaagacuccuacauuuuaagaggaagcagaagugucaguuuggcuuuuuauuuuggggugcacugugaugccuucuaagauucugggaaguuaauugggguagcuuacaaggaguuggcuuauacaccaauuucuuagugcucaugauuuuuuuguuuuucaugcauauccuauucuuuauacuucaaugaaguugacuuuucacauguuuugguuuuauaacuuaaagcacaucuuuuuuuuuuuuuguauucccuuguuucacagggaucuugccuugcuacuuucugcaaauaacacauuuuuaugcaauaaagaugagaaugaucauaaccauuggcaacccugagauaccuggccuguuguaccuuuagccacugcucgcacacaucaacgaucaacugauggaaugugacuggcccauugagggaccagagcaguguguugaaaaaauaaggacuauaugcucugucacuaccaugagcuugacaaaugaaaacguuuucaucagcauccuacaccagggucccccacccucaccaauugaguaauuuccccauaaauggacaaugaaguauaaauagcuaaaucauauucagugaaacguaauaaagauauguacuucugggguuauaauccacagaugguaagucagagauaacuuuuuuuuucccaaaagaaguuuaagcucauuaaaaguaguggauuuggaaauaaauccuguauugucccuacuguggugcaauuguacccuucccacucccucccucaaucccacuacacauaagucacagugcaaggauuaaagguagcaaaagggguaauacaguacccauaauaaagggcugaggggaggaaccaccgcuccaccccauccaaguuggagcaagauuauccuauauaaaauagaaauauauaguuuauuauuaguuagaaagcugauaugacagaacauuugguguuacuuuuuguauaugaugcucacugccuguuucccuagcaacuaagacuugaguucuuuggaaaagguuuuuacgauuuucccagcuugggaaauuaaaacuacgaauuuaaauacaaguuuuauuugacccuagguauucacgacaucgguucauuccguucaauuucacaaguugaaaaaaaaauuuggacuggaaauuugaaauacaauaaauguucaaaagcugucagccaaaagugugcauaagacaugcaaaacacaaagggcaacgugaugauaacucguuuguuacuuucuaacuccuucucaagcacuaugcagcaugcuguguuugguaguguugcguagaagcacaugcuuugaaagagugacaaaaaacccaaaacaaaaugacugccugguugacacucggacacagcgauugcgguucuaugcugccaaggaggauaaagugagaguuucugaagauacucuagcucacuucccgcuuacaaucaucaucaugcccaaccucgccgccauccacaguuauauacucuuacaaaguagaaaaugucucauacuagaaauacaaaaaccagaaucaacagaagguugguuuugacuucacaaugccaaacugguggugaggaauugccgugaccuugagauauuuguggucucacuaugugccaagcugaccaaggagucagcuucguaauaucuacccagaauuuuuguuuugaugacuccaguuuuaaaaaagagaagcauaucaacaauaauugacaaaagcauuauuaacaauaauugauaaaguuauuucuacacaaaaggaaaauagacucauuuguuauggaaagucaauauuacauauaaaaaauaaacgacuggauuuaauaauauucuaaaagaucaaaguugaaguauaaucuaacaaccuuauauacguagcauuauucauuaaaggccugacacuauuacugauguuauggugugcugcuuguaggcaggagccuagcauggcuguccucugagccccuaacaacagcugacagagacagaugccaauauuuacacucaaccauuggacugaagucuggauaccugugguugaauuaggggaaggauugaagaaguugaaggggaggguaacuccauaggaagaccagcagucccaacuaacccagaccccagggagcuuccagagacugagcuaccaagcaggaacauacacaggcugggcagaagcagaggacugccuggccuggucucagugggagaagauguguauaauccuugaggaacuugaagcccuggggaagagggaggccuagugagggagggagcauccucucagaggcaagggggaggaggaaugagaugagaaacuauaggagggggacagggaggagagguaauggcuggauuguuaaaaaaugcgaaagaaaaagaaacauaaaaaaaccauaaaaaguugaaaaaugugaauuuaaauuuagcucauguauuuuuauauaaaauguauaaaaacaauguuuuccuugacaacugaaauugcuauucugaaacgaaagugcucuuuuaauuggaaaagcauuuaaguuuugcauaauugggagaaaauuuaugauacauuuuuaauacaaaugugauuucuugugugagaaucaaagcuccuuugugcuuacuuggaucuacugaagagaaguuuucauaugugcuagagaaauuaaaaauuggacagguuucuuacaguauaguauaauaaaauuuauaauagguuuuuauggggggacacaggcugaaagcccucuauguggugcagagaggagccuguuuguuggagccuugguuuguaagugucaggacaaugagcacucuuugccuuauacauuucaucugauugguuuaaagagcguaaauuuuggaucuuaauaaaaaaauaauuuucacacggcacaucuucuauaaaugauuguauaaugcuuugaaauaaucaucauaacaaugagccaauaaaugcaaaaaucugauacguguugaauuauggagaggggaauaaugcuuugcucaaaagagcaacauaaaacucuguguaacugagaaccgagguuuaaguuaagguugacgagccauguauggcaaugaauaaaaauacauguucuuuuuccuuaucagcuguauugucauaagauguguauguauuuauaguaauuaaauuagugucuuacuuauucaaugucauuaauuuaguuacaguugaggcaguauuauuauacuccagucaaugguuaauaucugcccuuggauauauucaaauaaugagaauuuuggcauuguaaagacaaaacauuuaacaauucuucauuuuuuccuuuguauucauacacauuugugauucacauuacuuuccauaggaucccuuaaguacugaugggcugucauagaggagaacgauaugaaacaaaauuaucucuagguaauuauuacaugacucaacuuaguucuuuaagagaguaucugccccucccccuuuguauuaggaauuauaaggaaacucccaagaucgauuaugaacuaaggucauuuuaauuagcaaagcagauaaaugauauuaaaucauuuucaaagaggccgauuuucucuugcauaucaccaagaaguaaauaugcaacagagaaaaggguaaaguagcaaguuugcaaaggguugccauuccuuuugcaugcacguguuuuucguuaguuaaguugaacucagccuagcuuugacaauauacaacgcugcagaguuuuccuuuuucuuacccucaucccuucaaaucgugauaaggcucuuaggggucucagagcucuuaguguccuuagggauuugauggccccgaguucagaguaacccaaggcauuugcuguuaaacugaccaaugaaaccuguacaauacaaauaacaaugaaucaauaacaccgcuuucguccaauuugcaguuaucaacuaauacaacagauaaaguuuuauucauagcuguucuguuauucuacugaauaaacacagcaauagugacuccuaaugaugaacggcuuuauccauagaucacugccccaccuaacccucgccagagaagcucucucuugcaguaggugaugguuaacagggacccacaacuggacagugcugagugagaguccuuggaaagcucaguacuaaauaggauaucuucaugaaaccccuccucucacuccuuagagagcuauguggaagaggaggcuaaagaguuuaagagcacuuguuggcauccacaauaaugucuggguuugguagcuguauaugggauggauccccagguggagcagucucugggaugucaacaagugcuugcugacaggagccugauauagcugucuccugagaggcucugccagugccugacaaauacagagguggaugcucucagccaaccauugggcugaacacagggucccuagugaaggaguuagagaaaggacccaagcuguugaagggguuugcagcacccuaggaggaacaacaauaugagccaaccaggacccccagagcucccagggacuaaaccacuaaccaaagagaacacaugguggggacucauggcuccagcugcauauguagcagaggauggccuugugggacgcuguuccuaugaagcuucuauaccccaguguaggggaaugccagggcuaggaagcuggaguggguggguugguaagcauggggaguugggaagggauaagggguuuucagaggggaaacaaaaaaaaaggggauaacauuugaaauguaaauaaaauaacuaauaaaauuuuuuuuuaaaaaaguuuaagagcuagagguggggagugacuccaagaaaauuagugucuuccagauacaacagggugagggacauaugagcucacaauggugacagacuugacggacaagacuuguggaaaauuuaaacuggacuaaauuguagcgugggggaggggaggugagcaggaaguuuuuaccccuaaccaagaugcuauuugauaaugcugggagagaaaaaucaguuuuccucaagggagugacacuggguauaugaaccacacucagggcagucugcaagagcagaaguagcuggucuacccaaauguucucgaauuugauuuuuguuugugugcucuuauuuuguuguuauuaugguuuagugguugguuguuuucguuuuuuuuuuuuuuguuguuguaguuuuuuguuuguuuuugcuuguguuuuauugcuuauuuuuuuauuuucuuuuuucuucccuuuccuuuccuuuccuuuccuuuccuuuccuuuccuuuccuuuccuuuccuuuccuuuccuuuccuuuccuuuccuuuccuuuccuuuccuuuccuuuccuuccuuccucucucucuuccuuccuuccuuccuucguucuuccuuucugucugucugucuuucuuuuucuuuauuucucuuuuuuccuuccuuccuuccuuccuuccuuccuucuuucugucuuucugucugucuuccuuccuucuuucuuuucuuucucucuuucuuucucucucucucucucccucccucucucucucucucucucucucucuuucuuucucuuucuuccuuuucuuuuuauaaagagaauggaguugucaggauaucaagacaggaggaucugggaggacuugggggaagguaagcaauauaaugcaaaauacaccguagaaaaauuuacacuguaugaaaaguuuaaaaguaauaaaauauuaaaaggacauaaaugaauaucaagaguaaagaauuugcaaaauaccaaguccuaaccccacuuggaguuaugaaagcauaagcuaaugccuauugauuaauuuccucucucuuuucuguaaaacugaugacuccuuugagauuuccaucaauuugcucacuccauuuuggccucacugaguggcccuguuacuuguuuuuaaguauucauaacuaaaauucuccauaacucacuauucucaaauucucacuauucauaacuaaaauucuccauaacucacuauucucaaauucucacuauucauaacuaaaauucuccauaaggauauuugguacaucaaggacucuguaaaucucauuuacauaaaagaaaauuucuuccucaucauuaaguagguuuguuuuccccuacccucuguaaccuuacuuguaauagacuuaaaaaucucuccguaaaaucuuccaguagauaagaaagauuuauaagauuacaauagugcucaccaucccuucuguaucuugcuauuauuuaccacuggggaagaacaucaaugaauaagugcaugaagacccaaucuggagucggucaaguuuauaacauggcagaauagacaccauaccuuuuaaaugucuuuuucuaucauuugcauuauauauuaccaauaucauuguuuaaauuugguuuuccuacuagaucuuaucuccucuuuuuaaauuaguuaguaaauuaguccagaacuuguaaguucuaugcuauuauuaggugagagaguuuagggcuggggagccuaucuugucaucacaacacaguggcccgagacucauucauugguuuagaauugggauacaaacaagacaaacucccucaaacaaaaggcacgacauggaaaauaccuacaucaacaauuaagaagucuagccaacaccaggcauuggugaaguauguuugauagccauaggccacccauuugaggagcaucuccaggaugaaaauguaagugaagacuuugucagcauacuccagcaugguuuugaucgucuuucgcugaucaauauauauauccucaaaggccuagaaagaaaagguuacacauuuuagcuuucaaacacuacuagaaucuuacagcuagcuuuuucugauuauauaugcacaugguauuuccuugggauggaagaacggggauacaguauugcuauugcuuuguuacucucugaguuuuauccuuauaaaccagagagaaagauauacuuuagauagcuacuaaaaccagagaggggggaggugucuucaugacuucacucuuccugaagugaaaugguaauuuccugagucaauuggcuaagccaggauguauuucuuaaugucacauuccaugcagccauggcgugucucucucucucucucucucucucucucucucucucucucucucucucucucuuuguuauuggauauuuucuuuauuuacaucucaaauguuauccccuuucccaguuccccacucuuggaaagccccuaucccaucccccaucccccugcauuuguaaggcuuugacaggccucauaggagagagcuauaucaggcuucuuucagcaagcauuucuuggcauucacaauagugucuggguuuggugacuguauaugggaugaauucccagguaggacagacucuggauggccuuuccuucagucucugcucuauacuuugucuccauauuuguuccuaugaguauuuuguuccccuuucuaagaaggaccaaagcacccacacuuuggucuuccuucuuuaguuucauguggucugugaauuguaucuuggguauuuggagcuuuugggcuaauauccacuucucagugagugcauaccauguguguucuuuugugauuggguuaacucacucaggaugauauuuucuaguuucauccauuugccuaagaauuucauaauuucauugucuuaauagcugacuccauuguguaaauguaccacguuuucuguauccauuccacuuuuugaccuuagccauucugacugguaugagguagaaucucagggcuguuuugauuugcauuucucuuaugauuaaggauguugaacacuuuuauaggugcuucucagccauucuauauuccucaguugacaauucuuucuuuagcucuguacccuguuucuuuguuucuaugcugugggugugacucaguggcuagaacaguugucuacgugagaccaguagcuugacuuccagcaaaaaccaaauuucucucauuauuauguuuuuuuuauaggagagagauuaaaucaauaagugauuuaucaauauacuguccaauuuuauuuuacuaagcaguuaacugcuuuuuugggguuuuguugauaauucuacuucuuuacuuuuucuuucuuuucuuuuguuuguuuguuuuguuuguuuguuuguuuguuguuuguuuuacaagacaggguuacucuguauaauagcccuggcuauccucacuuuguagaguaggcuggggcucuaacucacaaacaucugucuaccucuuccugauggaauuaagggugugcaccaccacaucuagcugauaauuuuacuuuuugguacguauaguaugacauuacuuaauaggaaugucauauuacuuuucaauuagauccaccuaugccuuuuccuaacauaaaccucagcugguaauuuacuucuaauauauauuucuuucaaugaugaaaagucauuuuugucuaugauaugcagauauguagauaaugauauguagaagacaguuauuccaucaacaauuuuauagaaaaauauauacuugauuuuaaaacuuguaagucauuguguuuuaaucaggcaaacacuugugcuuauuuauuuauguauauauucuaucauuuaucuaaaucuauauaucaucuaucuaucuaucuaucuaucuaucuaucuaucuaucuaucuaucuaucuauaguuucucuauuaucaaucucuccaaacauuuuauuuuaugacuucaauauauuuuuauaucuaaaauucugucaauauaguuguauauauguaaacaauuuucaucuaaauuuaaauagauucugaugaaauuaacauguuucuauaaacauaauccagucuuuaaguaaucacuuagguauggugcccacuacuuagcauuaccaauaucauuuguuuccugaguagcccaagaauagugaacacacaugaaaagggacagagaagagguccccaacgaccuaccaagcuuccacaaagaguucaucagaacucagaggauauauaaccacuauaauagcacuaacaugaacucugaugugcuccucauagucauguuuaguuaagcaaagaggaauauucacuuuguuuauaaugacuaagcaaaagggacccguuuuuuuugaucuguuucaugauaagcaaacaucgaugaaugauuagaaaugugugugcacacauagaugcaaacccagaaaugcagcuagucauuaacuaucuggcaggaagauaaaaggguguuguuauugaagacucauugauaacuaaggcaaugggaaacaaaggcuuaaagagugugagauuuucccaguugcuacugaagcacuuuggguuaagguucacucaccagggcaccacuacucaggagaaucaugaacacaaugaaggucucaaaccaguuguguucaacuauucggaagcacguccuccguagguuccaccacuguuucccucuuccuucuuccacgcugauuugacagcacuugaaucucuggacacagccugcaagcauacgguuccaauaggaguaugaaagauagcucuaccaccuccauuauacauugcaucagcccagcuucaucccuccaccaccagcgcuauuccuaauuugcuuuaacuuuuaaaaaguguguaauuuauaagcaauggcaaaucaaugaaaacauacagcaucuucauauuuugccuuuucucugacacaauguugccuucaaagaaaacucauuguaaauuacaaauaacgacauguaguuugccuuuugugguuguucuuuucucaucucucucuuuuuuuuuauuuuaauuuuaaaaauuucuuuaauccuuuuuuauaguccaguauuuaucccacuccuggucuggccccuuacugcuccucaucccauauuucccuacccuaguauguaagaggaugugcccacccacaccccaccagaccuccccacucccugggaccucaaaucucucaaggguuaggugcauuuucucucacugaagcuagaccaggaaguccucugcuguauauguguugggggucucaucagcugguguauacugccuguugguggcucagugucugaggcaucuugggaguccaggucaguugagagugcuggucuuccauggggccaaccuccuccucagcuucuuccugcuuuucucuaauucaaccacgggagucccuggcuucugugcacugguugggugcuaguaucugcaucugacuuuuuauggucugaaauuaaugcauuugguuggagcuacucuagaaaaggguuucaaaaugaaauuaauaccuggacagaaaccuccucuccuaaguguguauucuuguggugcuccugaaaggguguuccugguuuccuaaguugucugaguuugcuaacaggugacuuuccuggacuugcuuugaugugucuuuuacguccucacauugcuuuuauauacugaaucuagccugugggccucacucucuacaaggucuauuacauuuaagccacccacuuugggugaucgacaguugaaaaggccguacuccguaugaacugcaagcgaugucacccgcaucuuuaccuucagugaagcaagcuucgggcucaaggguuucuucugguucaaugacaggcuguuccucugcaggcgccccaaugucuacugugcuucccucugaggagcuacugcuuucguugaguuucugggcauaaaaugaucauaaaaagcaaauucuuuuaauuuaauuccccaaugaaugacauaccaagaagggauuauuuuucucaagguaaggugcuaauguaaauugagaguaaaacgaagacucagaagaagagggaaugggaaaaccuaacuguugauuccuaccccaggaauuucugugugcagauugcugcgcugugcugggaugucacaaauugaccaucagcaacauguagugagggaacuccuaucccauggauuggggaaggagagagugucgugacuuguaggaauggggagagagauaagggaaaugaagcucggagaaucucuaccugagaagaaaauaaaaccauuaagcuagucuguguuuaaacauuuacauauguuucucuaauagugucucaauucugagaaauuauaacauaaugcuuuaacuuacacuuccuguuagaacagaggaucagaauuauuuauuauaaauguauucauauuuuuauauuucauaugccuuuuggagaaaagguguuuuacaauaaguuaaaaauacaucaauaaacaaauagccuuagacucuuaauuaaagggguucauuauuggaaaauauuuucgaaccuaaaguguugcagaaacagaccaauaaaugcauggaaaagucaguuuccgcucaacaaguaacacacuaauaucccacguaaagcuaauucaacagaaacagcguuucucagacuuuggcaguagucaccagacacauggugcucuuuggauccuuaggagucaaagauggcaaaaacagcagaaaauaucaacuuauccugcugaccuucaaauuguuguaagaguaaauaguacacuuggcaauuuagucaaguuaagauacacugagcgccaacaaugugcuagaaacuugguguucauuggcaacuauaaaauccguagcccuauuagauacuugaaauaaaauacgauguuuuucaaacgauggauuuauguuuaaucuaaaagagaucucaccaacuacccagucaacacauauuuuuaaauaauaaacuuuaagcaucaugcuaaaacuacuacuacuaauucguauacaugaaacaguuuucuuuguuccaucaaaggaagauggcuucuacaccugggccucuauccagcugacugucucucuuccuuuuaaauuucuuguuaaauagaaaauuaaaggucacaaggaucugcauugacaugaaagaccagucaugguucugagugucuguuuuaaagauuaccucuguuauuauacauagauucuucacuggaagcuaguuuuaaguuuuuaaauaauuaugacuauagcacguuuacauauucaucaucuggagaauuugcuccucugcacaggauacagcaacagguagacuuuaaaucuacacugcauuugcuuugaaugauucaaccauuucuucugacuuaaaaacauauccaaggauaagucaugcauuuggccauauaauaagugaagagacuauaauaaauggcuagucugugugcuugaguuacagugcccauucugaggauuccugugucuuuccucaacauaacuggaaucuauaauuggcuguaaugugcuacaagaauuauuucuuauuuccuaaaaaaaacccugugaguagaauuuuaucauuauccagcauucuucuucuucuccuccuccuccuccuccuccuccuccuccuccuucuucuucuucuucuucuucuucuucuccuucuccuccuccuccuccuccuccuccuucucucucucuauauauaugucugucuguguguauucucuuuguauaauaaguaaauugauuugagaaguuaagaguccuuaccaaaauucauuaauuacuagaaaucccaucuuccucccucugaauaaacuuaugugugggcagggauucagauaaacuuuauuguaaauagaaauuuuaacuugcugagcauguaacagugaucuguuagaucucuacagauauuuugcucucugucaagaaucacaauaucagguaccauucagauaaaaccuaaucuucagugauaucauuuuucagugucaaguagaacaaaacgcucucaagcagccuuucuacaacaauggcauuugcuaguaagauacugcauauagcugguucuacgucuugccagccauaucauguuuuucacaaugaccacuguuuucauugacgugugaaguacugacuucuuauucuacguuuaaaagauuacuuaguugauggaacuaaauacuauuuuucuuguucuaagaaaaaggagucugaacaggugagagggugcgccacagaaccggauagcuucugggacaggcggaggcacagagccacugaggcagcauccuuugcgggcagcagacagccggccaccgucuggacaagaggacagguguccgccuggcucagaaggcagccucagccuaaggagcagcugucgccaucuugguuccgggacuccgcagaaccuaggaaauuagucugaacaggugagagggugcgccacaaaaccggacagcuucugggacagguggaggcacagagccacugaggcagcacccuuugcaggccgcagacagccggccaccguccggaccagaggacagguguccgccuggcucggaaggcggccucagccucaggagcaguggucgccaucuugguuccaggacucugcagaacuuaggaaauuagucugcacaggugagagucugcaccacagaagcugacagcuucugggaccugccaaagcaacacagcuucugagaaagguccuguuuugggccuucuucuucggccaggaggagguccaaacacaagauaucugcgcaccuucccuguaagagagcuugccagcagagagugcucugagcacuaaaacucagaggagagaaucugucucccaggucugcucauagacaguaacagaaucaccagaagaacaaucucuaaacagagucaacuauaacuacuaacuccagagauuaccagauggcgaaagguaaacguaggaaucuuacuaacaggacccaagaccacucaccaucaucagaacccagcacucccacuucgcccaguccagggcaccccaacacacccgaaaaccuagacccagauuuaaaagcauaucucaugaugaugguagaggacaucaagaaggacuuuaauaacucacuuaaagaaauacaggagaacacugcuaaagaguuacaaguccuuaaagaaaaacaggaaaacacaaucaaacagguagaagucuuuacagaaaaagaggaaaaaacauacaaacaggugauggaaaugaacaaaaccauacuagaccuaaaaagggaaguagacacaauaaagaaacucaaagugaggcaacacuggagauagaaacccuaggaaagaaaucuggaaccauagauuugagcaucagcaacagaauacaagagauggaagagagaaucucaggugcagaagauuccauagagaacaucggcacaacaaucaaagaaaaugguaaaugcaaaaagauccuaacucaaaauacccaggaaauccaggacacaaugagaagaccaaaccuacggauaauaggaguggaugagaaugaagauuuucaacucaaaggaccagcaaacaucuucaacaaaauuauugaagaaaacuucccaaaccuaaagaaagagaugcccaugaacauacaagaagccuacagaacuccaaacagacuggaccagagaagaaauuccuccugacacauaauaaucagaacaucaaauucacuaaauaaagauagaauacuaaaagcaguaagggaaaaaagucaaguaacauauauaaaggcaagccuaucagaauuacaccagauuuuucaccagagacuaugaaagccagaagagccuggacagauguuauacagacacuaagaaaacacaaauuccagcccaggcuacuauacccagccaaacucucaauuaccauagauggagaaaccaaaguauuccacgacaaaaccaaauucacacauuaucucuccacgaauccagcccuucaaaggauaauaacaggaaaaaaaaaaaaaaccaauacaagaacgggaacaaugcccuagaaaaaacaagacgauaaucccucaacaaaccuaaaagaagacagccacaagaacagaaugccaacuuuaacaacaaaaauaacaggaagcaacaauuacuuuuccuuaauaucucuuaauaucaauggucucaacucuccaauaaaaagacacagacuaaaaaacuggcuacacaaacaagacccaacauuuugcugcuuacaggaaacucaucucagagaaaaagauagacacuaccucagaaugaaaggcuggaaaacaauuuuccaagcaaaugguaugaagaaacaagcuggaguagccauccuaauaucugauaagauugacuucuaacccaaagucaacaaaaaagacaaggaggggcacuucauucucaucaaagguaaaauccuccaagaggaaaucucaauucugaauaucuaugcuccaaauacaagggcagccacauucauuaaagaaacuuuaguaaagcucaaagcacacauugcaccucacacaauaauagugggagacuucaacacaccacuuucaccaauggacagaucauggaaacagaaacuaaacagggacacaagugaaacuaacagaagugaugaaacaaauggaucugacagauaucuacagaacauuuuauccuaaaacaaaaggauauaccuucuucucaguaccucaugguaccuucuccaaaauugaccacauaauaggucacaaaacaggccucaacagaugcaaacauauugaaauugucccauguauccuaucagaucaccaugcacuaaggcugaucuucaauaacaaaauaaauaauagaaagccaacauucacguggaaacugaacaacacacuucucaaugauaccuuggucaaggaaggaauaaagaaagaaauuagggacuucuuagaguucaaugaaaaugaagccacuucauacccaaacuuaugggacacaaugaaagcauuccuaagaggaaaacucauagcucugagugccuccaaaaagaaacuagagagagcauacauuagcagcuugacaacacaccuaaaagcucuagaacaaaaggaagcacauucacccaagaggaguagaaggcaggaaauaaucaaacucaggggcgaaaucaaccaaguggaaacaagaagaacuauucagagaaucaaccaaucgaggagcugguucuuugagaaacucaacaagauagacaaacccuuagccagacucacuagaggguacagggaaagcauucuaauuaacaaaaucagaaaugaaaagggagacauaacaacagauccugaagaaauccaaaacaccaucagauccuucuacaaaaggcuauacucaacaaaacuggagaaccuggaugaaauggagaaguuucuagacagauaccagguaccaaaguugaaucaagaucagguuaaugaucuaaacagcccgauaucccccaaagaaauagaagcagucauuaauagucucccaaccaaaaaaagcccaggaccagauggguuuagugcagaguucuaucagaccuucaaagaagaucuaaucccaguucuucacaaacuauuccacaaaauagaaacagaagguacucuacccaacucauucuaugaagccgcaauuacucugauaccuaaaccacaaaaagaucccacaaagauagagaacuucagaccaauaucccuuaugaauauugaugcaaaaauccucaauaaaguucuugcuaaucgaauccaagaacacaucaaaacaaucauccauccugaccaaguagguuucaucccagggauggagggaugguucaauauacagaaauccaucaacguaauccaguauauaaacaaacucaaagacaaaaaccacaugaucaucucguuagaugccgagaaagcauuugacaaaauccaacacccauucaugauaaaagucuuggaaagaucaggaauucaaggcccauaccuaaacaugauaaaagcaaucuacagcaaucccacuaaaaucagggacuagacaaggcugucuacucucucccuaccuauucaacauuguacuugaaguccuagccagagcaauuagacaacaaaaggagaucaaggggauacaaauuggaaaggaagaagucaaaauaucacuuuuugcagaugauaugauaguauuuauaagugacccuaaaaauuccaccagagaacuccuaagccugauaaacagcuucagugaaguagcuggauauaaaauuaacucaaacaagucaauggccuuucucuacacaaaggacaaacuggcugagaaagaaauuagggaaacaacacccuucucaauagccacaaauaauauaaaauaccuaggcgugacucuaacuaaggaagugaaagaucucuaugacaagaacuucaagucucugaagaaagaaauuaaagaagaucucagaagauggaaagaucucccaugcucaugcaucggcaggaucaauauaguaaaaauggcuaucuugccaaaagcaaucuacagauucaaugcaauccccaucaaaauuccaacucaauucuucaacgaauuaaaaagggcaaucggcagauccaucuggaauaacaaaaaaccuaggauagcaaaaacucuucucaaggauaaaagaaccucugguggaaucaccaugccugaccuaaagcuuuauuacagcgcaauugugaucaaaacugcaugguacugguauagagacagacaaguagaccaauggaacagaauugaagacccagagaugaacccacacaccuauggucacuugaucuuugacaagggagcuaaaaccauccaguggaaaaaagacaguauuuucaacaaauggugcuggcacaacuggcuguuaucauguagaagauuucgaauugauccaguacuaucuccuuguacuaaggucaaaucuaaguggauuaaggaucuccacauaaaaccagagacacugaaacuuauagaggagaaaguagggaaaagccucgaagauauggguacaggggaaaaaauccugaauagaacagcaauggcuugugcuguaagaucgagaaucgauaaaugggaccucauaaaauugcaaagcuucugcaaggcaaaagacaccgucaauaagacaaaaagaccaccaacagauugggaaaggaucuuuaccuaucccaaaucggacagggguucuaauauccaauauauauaaagaacucaagaagguagacuccauaaaaucaaauaaccccauuaaaaaauggggcucagaacugaacaaagauuucucacccgaggaauaccgaauggcagagaagcaccugaaaaaauguucaacaucuuuaaucaucagggaaauacaaaucaaaacaacccugagauuccaccucacaccagucagaauggcuaagaugaaaaauucaggugacagcagaugcuggcaaggauguggagaaagaggaacacuccuccauuguuggugggauugcaggcuuguacaaccacucuggaaaucagucuggcgguuccucagaaaauuggacauaguaauaccggaagauccagcaauaccucuucugggcauauauccagaagaugccccaaccgauaagaaggacacaugcuccacuauguucauagcagccuuauuuauaauagccagaagcuggaaagaacccagaugccccucaacagaggaauggauacaaaaaaugugguacauuuacacaauggaguacuacucagcuauuaaaaagaaugaauuuaugaaauuccuagccaaauagauggaccuggagggaaucaucuugagugagguaacccaaucacaaaggaacucucacaauauguacucacugauaaguggauauuagcccagaaacuuaggauacccaagauauaagauauaauuugcuaaaaacauuaaacucaagagaaugaagaccaaaguguggacacuuugccuucuuagaauaggaaacaaaacacccauggaaggaguuacagagacaaaguuuggaagugugaugaaaggauggaccaucuagugauugccauauccagagauccaucccaugaucagcuuccaaaugcugacaccauugcauacacuagcaagauuuugcugaaaggacccagauauagcugucucuugugagacuaugccauggccuagcaaacacagaaguggaugcucacagucagcuauugaauggaccacagggcccccaauggaggaacuagagaaagcacccaaggaacuaaagggaauugcaacccuauagguggaacaacaauaugaacuaagcaguaccccggagcucuugucucuagcugcauauguaucaaaagauggccuagucggccaucacugcaaagagaggcccauuggacuugcaaacuuuauaugccccaguacaggggaaugccagggccaaaaagggggaguggguggguaggggaguggggggguauggggacuuuugguauagcauuggaaauguaaaugagcuaaauaccuaauaaaaaauggaaaaaaagaaaaaggcuuaucugagaaaugccuggaaugaaaauugcaagaacccaaaaggcacuauguuaucuuuugacacauuuucaaaauaucauuuuauguagaaggcaaauagauaugcacuucaaaaaauucauuuagacuguauuuacauucauauuucacauguugacuuuuuuaggcuaccuacauaaaauuuucacucuuccaaagucuuuguaaagaauauaugcagacugacaguuuuuccuuguuauuuuuauauuggcaucuuaauucauaaagauagucugaggcuuacauuauuucuauucaaacuuuauucuuuugaguugucgaaauauuucuuucuagugaggauauaaugggacaguaagacaaaaaaauaaaaagacaacaaacacugguguguacaaacucaaccaccuuuacuggaauuuugguuacauaaaggccuaaucuccuuauuuuuaaaugcaauucugucuucugacuuauauuuuaccuucaguuuaacugaccugaggucagauagccauauacaauaucugcuaucuugauuuucuaagcuuuacuuugaguuccgauauacuguuccuuuuuguaaacaucuauggauacuuguggauaauacuaacauuaaaaauacuaguaaugggcuacagaugguucagcgguuaagagcucugacuucucuuccagauguccugaguucaauuccccgcauccacauggcagcucucaaccaucuaaaacuccaguuccagagguucugacgcccucaucugaucuugugggaagaagauauguaaguaguacacagauagacauaaaagcaaauacucaugugugugcauguguguuuguguguguuugcaagucuuauuauaugaaauaaaauaaaggagucucaaugucgucauuuaauuuguuacauuuuaaucaugagauaaaacauugcuucagaacucuaaaagcaaagguaugcuuauuauuauuuaucucauuguuaaaacaaaaaguaagugcaguucuuugguuaaguuaucacugcuacucaaauagggaggaagcucaauagcucugagggaggggcucaccucaacuuugcacacagacauguuucauacaauauucuaaagauccuagguaacaaugcaacccaguguugucaaacaaguauuuuauuauuuuaaaacuuaaugaaguagacuaguuccuuuuuauucuuaaguugguauuaauuuuugcuuuuuaaaguauguuucuuaguguuuugaaauuaauaaaauauguuaaauccauuuuagcauuuaauaugcuauuaaucaaucuucaauuuauuaauucccuaauggacuaguuaauuagaggcuggguauauuuuuccauauaaaccgucugaucugugcaauccauauguacuuggcagguuauuuaugaggugagaugaucaguuacuaacugcgacccugaugguaagagcauuuucccuucaccguggauucaugcucccuuuuuuuuccuuuuuuuuuuuuuuuugcuuuuaaagauguucucugguagagaaaaugaccuugaaaaugaaacaaaacaaaacagcaacagaacaagccacagcuugggguuucuuuggaaggaaccagucaggugucucuuucuucucagcuuuaacuuuaaacgugagaugucuuuauuuugugaccuaguuuauuacagggauauuauuaauguauauuaaugaaaguuuacuuuuuauuuuuaagauuuauuauuauaucuaaguacacuguagcugucuucagacacaccagaagagggcgucagaucucauuacggauggcugugagccaccaugugguugcugggguuugaacucaggaccuuuggaagagcagucagugcucuuacccccugagcccgaaaguuuacuuuuuaauaagugauaaaaauaauugggauuuuguaacugaugggucauauagugcacugucauauguacagagagagagaugcaacaaagacuagcacggaaggaacuuaucuauaaaugaagcccauacucaucuaugaacaaagcaugacguguuuuuaaccuuagccuuucgcugacuugauacuuuuauacaaaaauauauaaaugagauuccugaugcucuguuuaucaguuauuauugucucaaaggguuaaaauacuuggcaaagcaguuuaaauggaagaacguuuucuuuuggcucauaguuucugagcaggcagugcaugaugguggggagagagcauguugguuuagagcagugcaugucauggugagcaagaaaaccaagaaagggaaagcagccucugcugguagucaucauugucgucaucuucgucuucuuccuccucuuccucuucuuucucccccucuuccuccucccccuccuccucuuccuccucuuccuccucuuccuuuuccuccuccuccuccaccuccuucuccuccuccuacuccugcuccuccuccuccucuuccuucuucuucuucuucuucuucuucuucuucuucuucuucuucuucuucuucuucuucuucuucuucuucuucuucuucuucuucuucuccuucuucauuucuucuucccccucuccuuuuauuauucagucugugcucccagucccugggugggugucauuuccauuuaaacauaguuuucuucuuaguuaacccuuuauauaaacucccuaauagauguacuuuggggugcaccuuacaguuuucuaggugguucuacauuuagccaaguagacaaugcagauuagccaucauacuccauagcauuaaauauaugaauguuaauauguuguuguguauauucugccuuaggagauauuucuaauguaugcauuaaaaucaaaaugaucacuauuaaugacucucaacaaagcaacacugucauaucaaagaaaaagacacuauugagacaguaguucuuauaaagcagcagggaagcucaaacaccagcccuuagugccccauaucaucaguuucccuaaugucggucucuacuacccuaacuucucaauauaaagacaggugguauucuccauacacccuguuuggguacuagcacaauaggcaaauugcauugacacaaucuauucuaauauacuaaaauuuaaaaaaaaugggguaacauauuggcuuuuaaacucuaacugggcgauggcuuguaauuuagaaacauuacaucucuaauguuuauacuauuguaauauccaugauuuuuaaaucagcagauuucugagcuacaagagcaugggaaaagaauggcuaugggcucuagggguucuguggacaaucagugaugaagaugucagugcucuuucuauuccugauuaaugcaaacagaagcuguacaaaugcgaaucauguuaauuuucaguggaaagauaauuuuauggauacuuuuuacaauacaauugcuuaucaguaauauucaguacauaauaaguagcugcuacuauuauucagccaauauuaaauguacgccuauagauucaaggacuuaagaugaggagauucaaacuagaacgaauuuuggaaauuuaucuugucagaaauuuagaaugauguguuuaaauaagauguuuuguugauauuuuuacuuuuagaugugaucuuauauguuucaggcuucccugaagcucacuaucuagcugagacguugaguuccugaucuuucugacuuuaccugcccaaugaugggcuuuuagucauuagguaccaugcucaacaaacauuuauuucacaguugacaucuaccauuuauuuccuagaaaacaccagguacuaaguaaacauuuuaaauaagacaauguucacauaguaguccuuaagacauucaguaaguuaaaaaaaaaaguccaucuuccucccacacuaaauccaucucauuggaguuaguaguuuccccacugucucacuucuguguuauuuugcuuucucuucuuucacgagaagaccccaaaauaucucaaugcagccacugcuaguuuuaauaucaguuccuacuucuaaaagugggaauuccaauaugacaccaaaguuuuuauaaaagcuugaaucaucauuaaauagacauauucaacaaccuaauaucaugucaugugucuaugcuuucugcucuaggaacuaccaaccaaaacacaccauuguuucccuugcuuaugguugauauaccagucgauuuuuaauaggaauagaguaucuuugaauagagugucuuuaaaguauuuagauuacucaagcucuaaauaugcuuuguuaucuuugagacuuccaugcaauagcauuauaucacagaaaucccacuguaagaugaaaauguaguuagagaaaaaaaaaccauucaggacacacaaaccacugaacaccauagcuagcaauauacacaggaauguguugguuguucagaaauaguaacgguaaguuagcccaaguuagagacaguccuaauauccacaaauguuuuagcuuuaauauuuucaaguaggaccucauggacugaauuacauuccccuacccauucuucuauccuaaauucaauugcugaaacugagagucucuaaauaucugaaggucuggcuugauaaugagcucuacuuaucuaaugacuccaagauucucauccaauagaguaauucccuuacaaguugaggaagagacaagagauccauuucuguucagugcaccuaucagucaggccuuguaaagacauagugagaagguggacaucuacaaccuuagcaaauaguccuccccagacacugacccugcaguaccauggucuugaaaugucugcuuuccagauugugaauaaauuuuuuuuuuuguguguguguaagccaucuauuucuuagcaccaugcuauuuuaugacauuauguaauuuuaaugugacaauugguagggagcacuuuuuuucugaaguucacucaguuauuuaaacugagaugacacacacaaaaauauuaaaacuuaaagacaaaggcuucagguucaaagugggguuccaccccucacagguuacaugcucuuagccagccaaagcugguuguuuuuuucuuuuguuuuguuuuguuuuguuuuuucacuugaaacuuuacaguaauauguuccuuucuguucauuacaaggauuaaguaacuaaugaugcuaguuuuuaauucauuauuuguacccauuuaacaaacagauuuuaagaaugagaaaacucauacaacaguauauuacauuuugcuuuggcauucaucucccugagaaaagauuuuuggaaucucaauaaaauaauauuugauauuauaucaaaaagguucuauagaaucauuaauacagaaaguauaauccauacauauauuuauacauauacaucuccccaauuuacagcaucuuaccucuuugcuuucuucuagaucugauucacugcuaaagucuucuguguuuaaguucucaaagucagacucucccacagcaaugggcacagucacagugaggcugggguuguuuaugaaugacauauaaucacucucaucaaugauguacuucuccacacugcugcccgucccuaugccacuugugguuccauucacaucuuucagacaguccagaucuuucccaauuucuguugugugguuagagauacaauugucuuuucuguuguuuagaucaucaaguggcuuaauuucaucuagaaucuucuguuucuuaacaaaggauuguugaaugaauucauauauuuuucuuuuuacauaagcuauuccuuugugcauccuguccacagcaaucugcagguuguucaucucauugucaucaucaguggcugcaagguugucugcacuaaaugagcucagaagcaaggccagaaagagguucaagaccuugaaaacagacauaaguauguguucaccacaacacagaggacauaggauggcuuauuccuuuagcuauagaaugaauaaccgaaugcuauaugagcaagauacagcacaggcauugcuagaaguuaagugggccaagaccagaaaacaugaggcccuggguucaacacuccgcccuagaaaaguuuugagcacucugaauuugugauauugcuccaucucuauguacaugaggcauucuuucuacugcucucaagaucucccauacaugaaaugaagaacuugaaugaauuaguuuaucauuauauuuaauauuauaugaguaaaagaagauauauuuacugagauacuuuaacaauuccaaauuuaaaaaugauuaauauuugcaauuauuuauuuaaauguauuuuggguuuucucucuucaugauuuuguguuguuggaugauaacugaaaaaaaucauagucaugaccaaauuuagaaugaaagucuucaacauaugcauggaccauucuuguuagcacuauucuauagcaaaaauugcccccuuucucccucacaugcacacgcacacauagacaucacacacaaacacacgcacauaacauauuuguguaaauuuuuaacaguccuaugcaauuuaauaacuaaaugcaaugaagugacugaauaaaauagaguugagaagccagguggcacaaucacuuuaauccaaguacuugggauggagaggcagguggaucucugaguucaagcccagcuagaucuacagagcaaguuccaggacagccagggauacagaaagaaaccuugucuuaaaaaaauagagcuguaaaauauggauuugagaguaaaauaucauagguaauauuaaugugcauacauuuguuuuaagauguauuucuauauuaccauaguagauugugauacuauacuuugccauguugcgguauauuuuuagaauaagaagauaaacauaucuuaagaucagaggcauuuaaaauuauuuaucaugaaagucauuuuuuaauaaauugggcacaaauuuguuauguuauugauguauuucugaaaugcauaucuaacuuggguacauaccacaagguucccaaucaccaugaccaucaugaagacaguaaggcacauagcuuguccugccaccuccaugcagucccacauggucucuauccacuccccacacagcacgcggaacacgaucaggaacgaguggaagaagucguucaugugccaacgugggaguuugcagucaguggcaauuuugcagacacaaucuuuguaacuuuuuccaaacagcugcaugccaaccacggcaaaaauaaagacaaugauggccaacaccagagucagguugcccagugcucccaccgaguuaccaaugaucuuaaugagcauauucagugugggccaagacuuugccaacuugaacacucggagcuagaaaaugagaacaaauuaauauacauuauuaugaucuucacaagcauuaauuaucuugagacuuacuaaagaauaaggggcugcagcucagagacagaacaccuccuuagugggcaugcagccaugagauccguugcuagcacuacacaccccuaaaaaauucugcuuacauuaucuugcucuaacuuucucagguucauaguuaauauuuagacccucauaggaagaaucuagcuuuuccagauuuuaauaauguggcucaucuucucugaaagugauuuccuaguugcauauuagaaacuauauucuuuaauuuguuucucugagaccaucuuccaaguuuuauagugucauauugauaucugaaugugaauaauuucugccaaaggauucauuugucaaaaagguucuaaguaacauugcauugagagcauugaugaaaauaaaaugaaaaauauuuauuaucuauuaauauuauaacagaggaaaaauauaaauaaaugcaauguauuguuaaaccuggauuauuugcuaugacucuuccucaaucuucagggaauuuguaugaaucuaucuaucuaucuaucuaucuaucuaucuaucuaucuaucuauccuuaauagaccugcaaacuuuuguuuuuauggaacauauuuuuuagaaguagaauuacaugcauacauuuuaugugaauaucgaagaguuauuuacauuuucaacauuuauuaaguuauuaaccauuucuauuaaacacacuucuucagguugaaaguauuaauuguccaagucauuagaaagaacacauuaucaacacagcaauagaaaaagauaucaguguucacgugacggggcuagugacagcucaaggcucuggguuauguaacccagcacugcaaacuuauaaaugauaauauuagaaaguuuacauaaauaggcuuuucagaagaaaguugccuuuguaaaaaaauauacaaauauuaccugagagauauuauuccccauuuagagguaucagccuacacaaaaacuuaaaaugauaauaguuuuguggaaaaguauagggaagcacuaugagagaacaccacuggggaaaacaguuauuauugcaguugucuuguuuaccagucgaaaugaacggagaacugacaauccuuccacauuggcaaggccaaguucuaccaggcugagugucacaaugaaaccaucaaagauauuccagccuucuuggaaguaauaguaaggauccauugcgaugauuuucaggaacauuucugcugugaaaaucccagugaagaccuaaaagcaaaaccauauuauuuaaauuaucuuagauagugauaacaucaaagauaauauuauauauauauauguauauacauauauauauauauauauauauauauauauauauauauauauauauauauauaaaagacuaaugcuacuucuacuuuuccauuauugauccuaagauuauccuacaaguuuauuugacaaugcugguuuauauuaguuuacuguuuuaugcucauagaagcuccaauaaccagauaguguaaaugcuguaacuauuuuauuacagaugaagagaacaauauuucaagguauauaaaaugcccaucuauuauuaaccaacuuccagaccucaugucaccuagacaagauuuugccccaaaacauuuuauuuguaaguuuaucuuuauucccuucaaaucauguguaucuuauauuauucucaucacuaucauuaauauuagucacaugcacuaaaagugcguuuccagaaucuaaauaguagagauuuaaaaauauaaauccacuauagcauaugcauauuuacauugucuuuaucagcaagauacuaaacauucuccuagauauuauauagaaugcauguuauacuuuagauaguucuuucuucaaauaaaaaccugagacuuuuaaguugagucugcuggaaaauauuuuaacaauuuaugcuucaaaguaaaaaauggagaauauugucgaaacuuucacuaaaaaugggcuuacuaaucauaugauguacaaaaugcacuagguacugucaauauuucaugauaugaaucuagaacagaacuuagacucccuugacccuggaaggaaaaaagauggagacacuuuuguguuaucauucuuugaaagagcauauaaggaagagaacucaugaccuuauuugaaccaucuggagcuaggacagagugaucuuaucauuuaaagaagaacauggccuuagauucugaaagaacaccauuacugacuuuuuaaauuauuauuacaggucuauguucuauuucucaguuuuugcacagacauuaaaggccauuauuuggcaaaagguaguguguacccgucuggauauuauugccuuagggaugcaggaauugugguugaaagaggucuaauaaacuauugaagauaauaaacaguuucuuaagcagaaaauuugaagaccaagcucauuuauuuaccuucuugcacacuuaccaaguuucccacuguaagaacaugguugaaauguucagucaugggguagugcuccauagccaugaagagcguauuuaacacaaugcagaugguaauggccagaucaacaaauggguccaucaccaccagguugacaauauguuuaacuuucagccaauauggagaacagucccaaauuaagaauauguuggaaaauuuauaccaacaggguggacauuucugccuggauucuucuaguucuagauuuaaaaaaaaaauagaagaaacaauaaccaauuauuugaaccaucuagagcuaggacacagugauucuaucauuuaaagaagaucauggccuuagauucugaaagaacaccauuacugacuuacaaauuuacaaauuuauuuuagauccacuaaacaugcucucaguagcaaacauauuucucuuugcugcaaagauaauuacuugauaaaaugguacaguaucauuagucauguacauagagauaggaaagaaaacuuuuuguuuuguuuuugcauagacaguguugcuuaacacuuggccucuauuacagugguugggcauauagacaaagguuccauggaaacauagccuggaacuauucacucuguguaaaauuucuuguuacugauaggcuacacaauuuuaagauuuaggacaaggauuaauguaauauauaaagaaaucauucuuuaugcuuugauuuugugaaagugacuuauucuuuucuccagucuuaaaauuauuucagaucauaauguaaggggccaugcugcugaaguuugaagcacauuacaacaaaggauuugugacuaauggauuagaaaccucuagcuguucccacauacuuauuaagacauuaaaaguucagaaguuuagaacauugaauuuaguauguaauacuuucagaauacaucaccagccauuugcuaguaggacuguuccuuuuacuuuuguucauagaguguacuugccaacacauaaguagagagaguugacuccaacaagauauugcaagauggcugaacugagggagguaggguuuguuaccaaccuucuacuguauuuguuaagaugcuggcuaugcucauugcccuuugccucugggaaggaucuucuagaaaguccauggaaacauggaaagagcucgaccuccucuuucucaucucaguuucagugguuguucccugcaaagcaaaugcuaaggcauuacaugacuagcuugagcaauacagcacagaaauaaauggagacagugauuuucaugaaagacaugcgucaugcgucuucaucuuugauggccaauggcagauacuggugacuuauuggaucauuaaccuggaauauucaaacaguuaaccauguagucauaaaggaaaauauaaaauuuugaccccuccuugauuuuauacucuuaugaaauaggaugcgaucaaaauauaguuaguaaagcuuugcauaggcauuuauagcuuguuuucaauuaaugaacauacugucaaaucuuaaugccuuaaaaucuuauauauggucaggccauuuuucacuuucgagaaaguagcuguuuaauuuuaagaaaauaccgaagaccauaacacacuuagcugucaucucaauuucuaagcauaagacauauacucauuuauuauaaaguauaugcugauccaugcaugugaugcaggggcaacaguuucauccaggauaccaaagcaauaagucaucugauuuacaccgagucaugccucgucaugcugauauauuuccaauuauuuuaucuggauuaauaauuuauuggugucucuguguagauuguuuugugaauaccuauaucagcauuucuuucuuagugagauaaauaugauccuuagaaaauguagguaaugaugaagcuaucuaagcacaguguuuuugaaaaucugaacuaaagcccagauaaacuguaagaguuuagugggaagauuuacuauacacccuuuacacuaaaaagucauucauuuaaucuuacaauaauagggcacuaggggugaugucuucauauguaaauucgguauggguacauagcaaaucauccaaggaaguaauuauuguucaauuaauccuuagcauauacaguagguaaugcauucagguuugugcaaggagugccgaggcgcuaacauuuagcugguuagucuauuaaaggugcuacaagaugcaggugcauucucagcucgaccaaccaggaaucauucucaagaguuccauucuguagaaacacuggcuggugcagcaaucauaggccagccaugccugaacuauguaaaacuuucuuacauugucaucaguagcuggcuuaucuauuaucaccucuggcagaagcuguccaacuggcgaugugggaacugaggguccaccaaccaaggaaaccacaccauugcaauccaccgugcugugcaucuucccauuggcuggaaacaccgccagcauucgggaggaccugcuggucuggcucagguuacuguugcgucgcucuccgugucuucggggaacgaacagugagucucuacggcucucauuauccucaaaggugcuguguucaucaucagcaaagucauucucagaccccacauccuuggcucgcccucuaaagcugaaaagacuuguucugcuauugcgucuuggggagaacagggaaccacgaaugcuuaacagagacugaaaguuugaaacacaugacaaaaaguaaaauuacauuagaacugccuguugaaauaguuuugcaaguuuaaguugaagaauauugcauuguuauuuuagagaggguagcacauuccuucugauuaauauaauuuauuggcauucagaugagauuaaauuaguucuauacaguauggcuuccagccauugauauuaaauaacagauagcuggagugcagccuaaaaguaaugggagaaaaaaaaauacccagccaccacgucucaaauuuaaacagagacauccuuaaaaaucucucuauguauguauccaccuacaaugaacaugggcagcaagacagcaacgguuuuuaauuucucucuccuuuuggauaauuccaacaauaguuuucacagacuauuuuaguucaguuuccuaaaaccauguuauuuauuuuuuugacacagcuguaaaacagauuacuuguagaaccagaaaguaaaaauuucgaaauucugaaugaugcacuuuucuauaaaguuuaucauggcuaauauuuuuaaaguucaugggauaauugauaaagaaguuaugggaugacaaccaacauggugccuuaaauuaaccaaagguacauuucugaguagcuaaccccuagucuacauuuuguugaugugguuagaauagcugcaagauuaaaugucauuacaauuaccagaaggcacauuuaacaugaaaagccaguucuccugucuuccaauccuguguuauuucaaaagcaccuaagaguggauuugcauauauguggaugggaaguaaaacuuucacauaacuacauagaggggaaaaaacaguuuuaaguguaaugcaacaguagucaauucgguugaugaaaacccauccaucuauuuaaauucucucucagauggcucacucucaucgguguauccaagaacucugcagugcguaccugaugcggggaagaguaccucuuuucauaugucagucuauucccuucuauggagaagcgaaaccccuuccuccugaugcugucuucagacucagacuuguggaauucaucaucaucuuucucuucuccuccagacugcucuuucuguuuccuuuuuuuccuccgauuucgucuuucuuuagcacucuucgaacucaacuuagaggcuucugaagagcuaucugagagccugccugcugcacugggcucccuggaauguucugaggcuguuguagccgcugccugcuauauagaggagaaaccaauucaguguguugcaagaaacgacugcauuaaaucuuuaagaugcucaaguuuggugugucauguccaaaaugcaagcuaacugaaaccaacaucuagaugauguuuuccagguaugaagggaaguuuuuuuuucuuuuuaacuaauaaugaauuuuaaaaauaaucuacuuuucuccaugguaacauuuauuaacuuugucugaugccgcagagauucguaagauucauuggcagucaagaauaacucaagauucuauucaaagcugguaaugagguagugagcagggguccucucagguuuccaugcuuaucaaaguguucaauaucuuccacauaguaucaacauauguggagauguuccacauaaucagcguuaugaaacauaucacaguuucuuccucacucuccccugauacaguuaucuauagaaaggagagaguugagagcuuucugcuaagcaaguuaaaagauguucaguucucuaaaagccaucccaacuaucuucauaucaauguuggcucuuacuaguuaugggguaagaugcuguguggucacagcuuguucuguuaugaagaaguuagaacuucuuagucaacauucuucccacaauucccuuaaucuagaacuguagcagauaaauuagcaugcuugaaguaacucuuuuuuuuuuuuauggucaagaugguuacaaauaaauuugauuuaaauaguuuaauuagucuuuuugaaaauacacauaaugaauucguaugucccauuuagaaaccacaaggaaacgugggcaauuggauucauuuuuuuuuuuuucauucagugagucagguacacugacaagccauggaaaggucaaguaaaccucuuguaguacuccauauugcuaaugaugcuucuuugccuaguggaugguuuugaccaagagaacauuuuauuaaaaggaaauugaacaaccccaccuaaagacauuguauuucugaauaaagaaaauaauaaauuacuuuaaugaaauggccaaauggguuuuauaugucaacuaaugaauuugcuugucagaaaagauuguugucuuaugauacuuuuucuaaugcuaguauauuugaguaaaagauuuuaaacuugggggggggcaaaaaagcccaaaguuacuauuucucuuuucuucuugauucuauuuaaagugauaaaaauaacauaagaagcaucuucuguagcuaguguaaaacagcucuguacaacuuagugaugugacuaggccaauucaaacuaaaaagaugacccauacauagaaguccuuggaguuugaugugcucagcuuucucacauccugucagaugacucugccuuuuguuucauuacagcucuuuguaacauggcagugaaagaggugacaccagaagacuagagaaaugaaggucggagauaagaccuacuugaacugcugaguaccugugcagccucuugcugcuucuuaaguugcuccaacaucugcugaaauucugccucuuucuguucagccuccuccaguguggccugauucugcuccucauaggccauggccaccacagccaggaucaaguuuaucagguagaaugagcccaagaaaaugaccagcacaaaaaauaucauguagguuuugccagcagcacgcaaugucuagaaacaagaauaugagaauuauuuuuacaauuaugucgguauugggugacuucacauuuuaacuuacuuguguauguggcagaacucugacaaaauuaacauugugucccaucaguauuucuuuaaccucuaucucuucuuucuucuuuaagauaagcauucauagucauaauaagggauucuuggauucaccaggaauaacaguugauagaaagcaauggggaccaccaugaaaaagcugagccuuucauggaaauuaaagagaccaauggaaaagguaauacuugagcagaggacagggcagagggaagacuuggcuuuugcuuaggagaaauuguaucuaagaggaaugagaaauagaauucaaggcauggagaaacagaacagaauuacucuccuuggcguuacuccauuuaaugcguauuguaaucaauggguuagaggaguccgagucauucuuucucuacuguaucaugcugcggguuguguuucaugacucaguuuguguucuuacacgcuuuuacuuaaauuuucagauucucaccaguugguauagauuuucccagaaguccugagucaucagucgaaacagggacaaaaaugcccaacugaagguaucaaagcuuguguaaccauaauuaggguuucuaccagcuuuuacacacauauauccuucuggacauuggcugcaaauggggaaaaagaaaguaugacaagacauucugcugucuucuuacucugguagaagccuacacuuacaaaauaaucuagucacuacuuaaaggacacaggcguguggaauccgaauugcugauacauuucccaccuuugacuccauaguaucuaucuuauuagcugcaagguauugauauugcuuaguaaccuuuuccccucacugugaagucuccaaaggugauucauagcuuuauacguacaccaagaaaauagcauuacagaucaaaguguugcuucuugcuuuacagaugaaacuuuaauauuuagauaauuucuuguuuuauuuauaucauaguuacugacaauuaguaugcauaaaguuaguugcuguuaucagucaauuucuagagccaaagauacacacagacacauccauauacaaacauauguauggggacauacuacacauacaucucacacgcgugaucagcuuacccugcaucagagcuauuuccacacagcagugcaucuaaaacacccuccaggaaauaaugauauccuguuugaaaaaaagagaaagccacaugauacacacuugcauugugaaacacauuaaaagaagaguaggaaagucaggucuuacuuuuugguucacuaagugaguuuacaaguaucuuaucauccacuuaaacacaugaguuuuuuccuuuucuuccuucaaauucuguuauuaaauuaaagguaucgauaaucaacuguacgagguuuuuuucuuuucauuauuaguggaauguuagugacaaccauggguacuuagggaacauuuaugaaaagguaucaguauuuucuacuacuuuuguaaaauaaagaaaaaguucaucauccaaagaagaugacaaugauggguaucucaaaaauaacuacauauuucaaaagaaaaaaaugauauauuuucuuguucuauuuucauauuuucaaucccuguuaaaacuuucaaauuaauuauaacuuacauuuuucaguucguaguauauaugucaauugacacaaauuguaucaacuaucugaauauuuuaaugaaaugaaauauuuuagaauugaauauaaaacaaauaauauuucuuacaaauuaaugaaaaauguagaacaucuuaaauauuaaaguuaaaacaauuagaguaggcgaacaucaaaucuuaucaguucucccuaguucucaagaguucacaucuuucauuacuagaggagccaugucugcaagacuuuccuuggccauccauuuccuuuccaucaaagauugacaaggaagaaacaaccucagguuguguccaguagguuguaugcucacacaguauccucagaaaaaccauuaucccauugcaacuacucauucaaaaaguauuagcgccgggcgugguggcgcacaccuuuaaucccagcacucgggaggcagaggcaggcggauuucugaguucgaggccagccuggucuacaaagugaguuccaggacagccagggcuauacagagaaacccugucucgaaaaaccaaaaaaaaaaaaaaaaaaaaaaaaaaaaaaaaaaagaaaaaaaaguauuagcaguauuagaaauaaagcgacguucauuaucccccuauaacuuaguugggauuuuguauccuuucaagaagugaaaugaguagauaggaacaacagaaaaaagagaauggaaacaggccaccucaggagguaggagguggggugacccucuagaauguaccagagaccaggaaggugagagacgcucagggggagggaccuuaggugaaaugcccaaccguggguagaaggaacuuguagagcccaccuccaguagaaagacaggacaucaaguggagggaugggguugccaucccaaagucaaaaacucugacccagaauuguuccugucuaaaagaacugcaggaacuaaaauggagaagagacugagggaaaggacguccagugccagccuaauuagggauccagcccaaggggagacuccaaggccugauacuauuacugaugauauggugugcuuauggacaggagccuagcauggcugcaaucugagagccccaacaagcagcugaaagagucagaugcagauacacccaaccaauggacagaagccaggaacuccugcaguugaauuagggaaaggcuggaagaagcugaggaggaugaccaccccauaggaagaccagcagucucaacuaaccuggauccccgagaccucucagacacugagccaccaaccaggcagcauguaccagcugauaugaggccccugacacauauacagcagaagacugccaggucuggguucagucagagaagauaaacuuaacccuugagagacuugagaucccagggaguggggagguuuggugggguggggugugggcgggguguagggacauccucuuggaaaugggguaggagggaggagguaugggaugaggacuagucagagggcagacuggaagugggauaaugacugaaagauuaaaguaaagaaagauuaaagaauaauaaaagaaauaagguguguaaauauuuucaaaauuuacaucagauaauuuucuaagugacuacaacauccuugugaucauguuuagucugugacuagacaggaagcaggcagacuaugaaaggauaaguacacauauugaugguucuuacuugagucuugaauguaugauuuccagucaaacucgaacacgguuucauuuacaagugugccauuguaauccauaguuauauucuucucuaugcuauguuccucaagggaagcguuggugggaggccacuguacacauuuauuccucagguugcccaugaagagcugcaacccgaugagugcgaacacacugagacagaacacagugaguaucaugacgucagacagcuucuucaccgacuggaucagggcccccacgauggucuucaggccugagagaaagaaguguaucaagcaucugaaauauuaaauaaguccuucacacaagucucucggagacacuaaauaaacguguaagucccaaaauguggcccauggcagggacauuguccuauaaaaaguucgagaguguagcuucauuuaagaacauagcauucaugcuguuguagguuauucuuuaagucuuauaauuggucuuuuguuagcaaagaaugggauuguuuuugcauaggcaucaauggguauaaugaauaaaaaugaaaaauuuauacauauaauagggaacaaauucuuuauaacauugacauuacaaaaauacuuuuuuuuucucgagacaggguuucucuguguagcccuggcugucuugaaacucacucuguagaccaggcuggccucgaacucagaaauccgccugccucugccucccaagugcuggaauuaaagguguauaccaccacuguccggcacaaaaauacauuauauaguaaaaguugguuggguugaauaucagaguguccacaaauuaaacacaaagguugauaaaaccuccagagagaguaaucuuauaggaaguacucagucuuaugauucucagcuuucuguaaugaugaauggcaagcaaggaggcucaguugaaaaagucucagaguuaacucacugauuaaccuacaugcuuucauauagcucucaccuggaaugacugaaauaguuuucaaugcucgaagaacucugaauguucucaaugcugagacauugcccagguccacaaacuccgucacauaucuguaaugaggaguucacacacagacacaauaacaggaagcaaagaaaguuuuguagguacaauuaccuuaugcuuuauaguaauugcuucuaauuagaaaugugggaauggucuuuagacucaauccucuaaaugugugaauagcuaaaaauuaccuagguauacaaacuuuguuacuuaccuguaaaugauuuaagauugaaaagacacuagcauuuaucugauauuuuaugaagaucuuugcugcuuuuaaauaguguaaguugcaaauuaaaauuuagacuucaucaauguagucuuauuuuucaugauaaauaccacaacuaaauguaaauuucauaaaauauacaaucuugaugccauuugguaggcaagguagaaacacuauaugugaauugggaaaauuaacuaaauuaauuaguuaacuggaaccaaauccacaggcuaggguuucagcuagaaaagaaaugauauaggaaaucauccaacagaacuaucgauuauaaaagauugccucuugccccacuauucaagacucgcauuuccuaaaauaacguuugaauagaaguugaacaaauaaauuaacaauagcaucuuacauggcccaaggccacucugucaucacuucuauuuuagucucaagagugagaagucucaaauacuguccugaaaguuguggcugaaacgcaugggaaccuuucauauuccaaucagacauaaaguuauacaguuaaggucagacauccaggauuugcacuuuggagccgaucaguaccaucuccuguccuguguaucccuucacuccugcugaugcccagaaagucagcuacccagaugggauaagugguauuaauccacuguccuccauaccuacuuuugacuauucuugaauagcuaccuauuauucucaucucuuccugguguggaggggcgugauuuaucacuagcaaaagggagaagacaggaaaguagggacugaauauacaacucaguguauauugaaaagcuuuguguugaguaaaauaaagaagagccuaaaaacaagagagggagggagggagggagggagagggagggagggagggagggagggagggagggagggagggagagagagagagagagagagcgagagagagagagagagagagagagagagagagagagagagagagagagagagagagagagaggaauacaaauugaaucagaagggaaauagaggcaagguaugucugcucaagaaauaaccauuuauuugauuuaugauguaucaaaugucuuuuucaccuuaggaucuuauuuccagcauggcuacaaucuuucuacuauucuauaaagguaacaaaagaagccacggggugaggcacaacaggacuaucagugaaaaguucagugcaaguuugugggaccagugcaaauuuugcugugugaacuuucaaaaccauccuccagcucaggagauaaauaaguuaugcuucaguauuacaaguauuugugugaggagaccagaauauacaauauuuucuuucuuuuugggggguagggggugagacaggauuucucucuauagcccuggcuguccuggaacucacucuguaaagcaggcugaccuugaacuuagaaauucaccugccucugucuccugagugcugggauuaaagguguucgccacaccugccuggcuacaaaauuuucugauguuuuaaguguuauuaaaauugcuauuacuauucucauggagcaguggaauggguuuacccuuuugagguaaauguuaagacacggaguucaggugcccaaaucaugccaggauguuuuaccacucgagcauguuguuuaaaaaccugagcauagacagcaaaccaaacuguauucucucagguuuccaaaagagaaggcacuuacgcgaauguaaugacagugaaguccagccaguuccaugggucgcgaaggaaaguaaaaucuucuaaacagaagccccuugcaauaauuuuuauuagugauucaaaaguauauauuccugugaagguguaccuagaaacaaguagccaaaucaauuaaggacuuuguaauuucauucagaguacaucagcuucuuagcauguuguccucggaaaacauggauaccaacaaaggaaacaugugaguuugaauaguuucagaauccaucacauacauaguuucuuaugguuuuuuuuuuguuuguuuguuuuguuuuguuuuuuucccagaaucugaccuuccauuuagaagcacuagaagaagaggcuuugggaaacacuguggggggugaaaggucagaaaccagagaguucuaggugucagaacaugggcaggcacgaaagcugcgauugaaacauccagagcuccaguuacauaacugccucuccuucuacuggggcaucaagagcuggccagugucauuaguaaugcuuccagcccuugagaaugcuuccugaauuuccacuguagacauuuuagccuuccauaaacugaauuuccaaguuuuauaauccugaaacuuuaguuaaguucuugaugaucauacuuaaaauagauauaaaccuggauaaaucccagugaucaagagacucaauaugguucuuuauuauuauuagauauuuacuuuauuuacauuucaaauguuguccacuuuccugcuuuccccucugaaaauccccuauccccuccccucucccccugcucaccaacccagccacacccucuuucuugcccuggcauuccccuacacugugguucuuaauguagcauuuacagcuuaaucauuuugauucuuaauuagcccaauuaauguggagguuaucuggaauaaaaaguccagcauauauugucuauauuucuguaguuacuuccaucaauuuucuuuucaaauacuggauccugaaagaaaacccuugaguuuucuaguagacuuuguaucaauuauaugaguaaagagaaauccuagaucugacaccagcaagccugggacccaaugacugcugucuuauuuuaaagcugcaucuauaaauggcuuuaucacacauguucuccaguuuaauuuaaaggcuacauugagaaauaguuucaaaaaucucaaauauauguacaggaacaaacauuuaaaauaaacuuacuccacauucuuuguccagucgggaggguuacucauugucauaaauacacaguuugucaaaauagugcacaugauuaacaugcugaauaauguagguuaguguuaaggaacauacaaaagaaaguucaugcauuguauuaaaaaaaaccaaaguaacacugaaaaacccagaccucaguucaacaggacucauggguaaacaugugcacaaauacuaccuaaucuccuuacauuucacucaaauuucauaugaugcuaaauaugcaucauagugugaccuccacaauuucagaguaaaugagaguauggaaggacauaagaauacaaguugcuauugcgguuguuuuuauaccagcaugauuaccuuccaaggugcuuuuucuaagcgggaaguggaggugguugggggggugguggaugcauuucucucuuuuaaaauguauuuaaauuuuauuugcaacauuguugagcagaaagcauggaugugaauuaauugcacaauuagaauaguaaauuuucgaggaaggugcauuucugcaauaccgagaucucgucguuaauggauagaauuuugacgucacggucaaagcagagcguggugcagagugcuaaguagccguguuuugagugaguuuauguaagcacaacagcaugagaagauggaaggggagaugugugaaggucagggcucaucgccacugggauguaauugaaauuccacagugacaccuguucuugggccaaucggucacuuauccuuucugugccuucaaccacccucuggcuccaccuacauucaacacccggauguuaagcuggacagacuuuguuauuggucgcguagauuaaaguaaucagugaguaugaaaugcucggaagcaaugccgcuggagaaauguguacgcacugagugguaggucagagaagaacagguaauagggccauugaaaguggcuguaaaaaguguuuuagaaaugccagaaauaaccgcuacguccuggagaaaacagaugauccgcaggaucuuaaaauauguguuuucugucuuaguagcagguauucuuucuacuacacucgacuaaccacacaaaacauuuccauuagguguagggaaagauuucaucaaaugaccacaugauggcacuagaaaugcaaacuaagauggaaaagcuuuugagugagcauaggcacuuuuuauaagguacaucuuuaguguucgaugauagacuauuaauaggacuaacgauuuacuugugaucaacuggacucaaaaagaagggccuuuauuuuuuguuguugcuuuuauuguuuuuguuaguuauuauuuuacuuucuuguuuuguuuuguaucuccuuuuguugguguagugcuguuuuuuuguuuguuuguuuuauuuuuuuuaaaugaacguuucuucuuuagucauuguuuuuuguagugccagggaacaaaucaaacccagagccuuguguuuggacaacucuuuagauuuuagaauuugugauuuuaaaaaaaaucuugcuaguaugaccuuaugauacuuacaauaguauuuuuauacuaauugugaccaaggccaccaaaagagacucagucauaaaugaagguuuuucacugaucaauauccacgccggaacugaguugcagaaaccuuuaaacccaaaggcgaccacagaggcaaacucccuucaaccuuuuagaacaguuuuagcuucuuuccugaaucugcacuaaagagacaaugcuauacaacagacccauauauucuguggcuuaaaucugauauucagccaacuucauaaaacugaucagaaaaguugacuaacuagcuaagccugaagugucuugagauucuuauaagcuuacaugauccccccaaaggucuuuaaaauggcauacaucauaucugugucuaaucuguauuuuacuuugaaaauaguuuuuuugugugugauuaauuuuacugaaaauuuuaugcaacucuguacaaagauguugacaagaaacauggcgaucuugcacaaaacuuaggggauucaauacauauaugaaagcuaguguuaguugucaaucugacagaaucuagaauacucuaacagacgggccucauugcaugucucuggggaauuauugugacugcuuuguuaauucagacggaaagacccaucuacuguggcuggcaccguucccuggcugggauccuggaauguagacuaggguucagggcugaaggggugccuuaaugguaggguguuucccugacauuucugaggccccggguucaauucucagcacuacaaaaacaaaaagagauuuccuugaccaacaaaagauauuagaugaaagcuauagaguauaugcacauuuuuuuaacuuaauaauacauagaagacacaaugaauacaaacaguuaacaccaaccacuugcaaaaggauaugaguguaccaaaaucuuaauagcuauuuuccuaagaggauugaaggguguuaaaauguacagggcggagguggcacugaaccggaagauggccuucccuuuauucaauacuauaaaagucuguaaaauaggaauaaacacauaaguauaaaacagacuuccuauuuuccaauaggguugcagugaauaauuccaauucagaugcccaggacaaucacuuuugauauguaccaugaguacagcucucucuggucacuuaugucccagagaugaacuuacaguggcucuuaccuuccaccaaccacuuaccugaguuugugcaucagccacgagaauguccucauuuccuuaauauuuuaagugucuuacuuaagccaaaguuugaaauggggacacauuucauuuucauccuaacauucacaagaauuccuucucauaaugauuuguuugccuagaugaaguaucaggaaaaugaauccugcaggaugcaaaaucauucaacagaaccgaauguuuuaaaaauaaauauuccuucacuacccgugcuuauaaaauaaacaucaucgcuccgcugguaauagagaacaaaagcagcuuccaucuagcccgcaccuauuggauggauacuauccagucauugauuucugcaggacaggcucccuggagaguaucuuguugaccaggagugcuaaauucuguauugggauuccugagguagcugacacuugguuucuaaucccaauugacucuccccuguguggaggaaaagcucaaggucccuggagaacucaggacccauaaauaugaagagcaucuacgacaagagucagacuuacuacacagcaaagaucagugugcagagggaaaagacucaccaugcaauggagcaacacggcuuagucugacacagucuucuaagucauuuacugauacucagccuaggccgagauggaugaagcugacaucucugugaauaacacacuaaauagagagaaugcuaagguuugaguuuauuuuuuuuuuagugacucuauucuaauuccuaaguauggggaaugcaauuaaggccuccugcaugcuaagcaaguguuuuaccauagggucauguucccagcucagggugugugugcacaugcguguauaaucuauaaccaacccagaguguuauacaagggauccaccaccgaaugcuguccccagcacagcuuuuaauauguuuaugcaucuauuccuuaaaacucccauguuuuagccuuuugaugcauagcucuauggacccugcuaugauuagcacacucuauaacgugccguuuguuuucuccugagcauuuuuugauagcauuucuucuucacauuuaaacuuuaggucacuaacauguuuucauuuuauuuuucacuuugaccuugagauuuucaaauggagcaauccuugaacacagaguuucuguuugaaaauagcccuuucucucugggauucaaacagaaaagcucuaaauguacuaugaaaauauccccuaaguaguggggaucuguuaguuuucucagcugugacacacacacacacacacacacacacacagacaaaauccaacuacugagaguaaaaccuguguuuagaaaguuguaaugcaauuuugagucuguugaaaaugaugauaaaauaaaacaagagacuguaggcugggcuaucccauuucauuucaguuacuuagcaauuaaugucacugugucauagauaaacagagaccacaucaccugggugggaaaagugcugcuucucuaagccugaccuuugaccacaugucaucuaaucaucacugaaugggugcauccagcacaagggagacgaccuuaagaugucugugagggaggaacgcacuccaguggcaaucgcuugugguugguacauaguucccguuauucucucugauucauucaauauuuuugucccuaaacgaccuugugaaagcaucauaaaacaugaauggacuuggguaagggaaauauccuugccuuaaggaaugugagcauccaaggacacagaacgagcaaagcuuaggaccaaugauuuuuuucaaaguucuugccuguaccuccuuauccagaaacacagccagucaaaugugauagaaauauugggggcuagaguaggaacuguaguuaaaaaaauuguaacuagaaagaauauauacucuucaccuaagaaucuaauuucauauauuacuauagaccgauuuugaaaugacuauggugauagagaugacaaacgaguuucaggguuacuguagcaucuuuuacaggcuggaggaugagucuugggagggucaguaguaguucagugggcagggaaauucccaggcucaucccauugaaacuggcuauacucagaaucgcaaugacacagguuccuuggcaaccuucuguuuacaugaugaguaaaggaagcuguagugguuugaaugagaauagccccaguaggcauguguauuucaauaugugggccucggaugucaaaacuguuugggaaggacuuuguuggaggucauguguuaacagauguagguuuugagguuccaaaaguccaaaccaaccucaguuuguguucucucugucugucucugucucugucugacucugucucugucucugucucugucucugucucucucucucucugucucucucugucucucucucucucucucugugugugugugugugugugugugugugugugugugugugugugucuuauucauggauacaguacaagcucucagccacuguuccagcaccaugcuggccugccugccugacugcugucauacuuucccccaugauggucauggacucaugcgaaccccuacaauaaaugcuuuccuuuucagguuuccuuagucauggaguuuuguuauggcaguagcaaagucaccacuacaggaacacuugacagaaaauagaaaagagaaaagaggaagcagggacaaaacaggaauuauuagugaggccaaagcugagacucugaaacuuagcaagagagaaccaggagggaacuuuaggcacuggaacucagcaaagcaguguugguaauagcucggcaaccccaguccugauuaauaauugaaaauuuggacgaccagugguugaacaccuugacauaauucuuaaauuuucaaagguuucuguccuuuaugauauauuugauacaucuauuuauuaaaugcaaauaauuuguaaaaacauguugcauaaagaacuucaugugcaauguagguggguugaaacaggagacugaugagcuuugacugcacagcaugcuuucuguacuuuaauuuuucauaagauuucuucccaccccugccaaggacuguaacaauagugccagccuugcagaaccacuuucauuguuucuuacccaaugauagauauauuccuuuuggauugaaacauacaugcaaaugcgagcuuccuacacaucacucugaaguguuuauggguuuagcuucaauagcuuugcaauagagacaguauucagacuuagauagcaccucauuauauguaggauuguagucguuaugaagucauuaaauuugauuuagaacuuaaguuuacuuuuuccaacuggucugcuauuuauuuuuuuacccgauaguaucuacuauguuccucacaacuuuacuauaguugagaagucagguuacaacugcagugccacucagaaauaccgcacugaaggcacugcauggaggaaagagaaaaggauccaaggggaucaauguucacuuaaaacaaaggauuaacuccaaagcuaccaaccacccagacaucccccuucucuauuuacaugugcaaauugcccaguggcaagcaccaagaguguaccuuuuaguagaagguacuaaaccuucuacuaaaccuaucccuugauucauuuauuauaggggggggggggauaaaugcuuuaaucucauuacugcaauggaguagaaauauaagcacuugaugagaacauuuuaauaccagaauaauuuucuuccuuggaacaaguuuuuaaacaaggcacaauggguaaauucagauauaaccuuuauguauaaaaacugguuuauagauguauuuaugggaacuaaguauuccuacuuaggccuuaggacuuuuccggcguguguguguguguguguguguguguguguguguguguguguguguguguguguguguuaaaaaaugucuuuguaauauuuauaugacaaaaaugaagucauaugcucuaauuuagguguaaaaggugacugauuagcacuauauuugcaaagcuuugugcugcauucugaaaagaaaacacacauaucuaaauccgggcacuugcaaaggaaugcucagcuacagauaguagcacagaugaaucuagaagacgaacauauggagguguagauagcuuagaacuaaccaauaggaacauaauguaaagacaaaccuguacuuuaaccaaggauuucugauugucuaaguacuacaugaaaagccaaggaagaggugaagugcgucuuacugguguuuucuguaacucgacaacauuugaggauaacaucauauuaaaaaaaucacugagguauuuuaugugauuuuuuucacaaugucuccagucuucucaaucuggucuuauucuauuuuagguacccguagccauacuagcugaugucuaucuacugugcugaacagauuugaccugacuuucaaccacucauugacagaccaagucacacucuucagcaacccuugauggaaaaauauuauuucagguguuaaagaaaagcauaaggugguuugauugaaaaccgauaagcaucccugguaaucaacaguuuuaaugaccccuccccuccugccaaaacaaagaaacaaagaaacaaagaaacaaacaaacaacucaaaccucagggaaaaauaacagcagauuugucucaaguuaagagcaagaguuuugugaagcaacaguuuugcugguuagcgauuaaucaguagugauucgccaguucucaaugguuauacaggauauguggacugggcccuucugcuugcugugaccuaguaacuucauagaacaugacuggcugcugcgauuacugucagggaugaaacuuggauuugacaagugguguauuugcacuuuuguuuucugaauauacagccauugguggaaacuuuauuucaaucaagagcccauuuaaaaaaaaaaaaaguauacaguuauaacuuaaguucuaauuuugcauuucaucuagacauugccagaaagcugugacauaacagagauuacauugaaauguacuccauucccucucuaaaaguuagcuacaggcaaaagucagagauaacaugugaaagugagcuggaugccaggcaugguggcgcacgccuuuaaucccaguacuuggguggcagaggcagguggauuucugaguuugaggccagccuggucuacagagugaguuccaggacacccaggcacccagggcuacacagagaaacccugucucaaaaaaaaaaccaaaaaacaaaaaaacaaaaacaaaaacaaaaagugagcuggauaacuagaaauauuuuaaaagcuguacauccagauguggagccucacucccguaaagcuagcagcccaaagcuaaggcaggaguguugugaguuugaggcaagauugagugcuggaauaaaaccuuuucucaaaagaaaaaccaaauaaauaguagguguuauaagcagacuaaauauauucuuugccuggaacuuuaaaucacaggggauuuuuaauucacacaucaucugccuucuaaaaauguaucuggcagucaauuccuuuggaauuuuaaugcaguuucacagaagagaguaaauaaauauguucuuuuuuauuguuuuuuuuuuuguuuguuugguugguugguuuuauuuguuuuguuuuuguuuuuugucucaaacucaauguaacuuucuuccccaggugcugggauccaagccaggcccaacaagugcuaaguaagcacuccuccagugaacuauucccaggccuuauguaauuccuaaagaaauauaauuaugaauuaauggugguuggaacuguaucacuauguagaaggaagugccagucuggaaauaguaacauggcucuaaguugggcucaggugcgcaucucuacucuguaagacucugguggucagacugagaaacugcccuaacccuaucagggaguggggcacauuuccagagguuccgcaguaaggggcgggggugggagggcagaaugagagucauguaccaacauagcgaugcuucaaagucugaugcuucagguagucagagauuccugucagucuccaucuccgugaacauuuuucauucuuguccaauccaugcgucuaagucuuuuucccucucugagaaucuuuaaauggucuccuuuccuccuccccuccucuuuuauauucauggcuucaaacaaagauuuuccucuuuggcucacgagggaugacaagucuccucacagcuuaccucacagcauuugcuucucggcagcaggcuaaccucaauuaaucuaacacagccuccaccaaguuaauggguaaggucuuuaagccacugauuacaagcugaaaugaccagagaguggaaagagggaauggguaucugagagucauuauugucacauuuauaaacuuugggagauaauuuaaaaguuaaacaguauugugcaaaaauagcaaaaauuauagauaucaguacuucacaauuaacuuaaguuuuaacuuuggaucuacucucauacaaaagagcgcacuguauacagagggaagauucugucacaucuauguuuucucagguuggaagagaaagcagggcagauggagggaaugcuauggcauuauuugaauugacauuuuuuugggaucuccuaaaugaugcccuucacuaacuuaaggccaucauaugauagaagaucuauuguauacccugcaacuagagaaucuaaccuccuccucauaugacaggccagaugcucuguuagcaucuucuauguuuuccuuuuuacagaagcuugucuucgcaucuaaauucagaugucauuuccuuucagaagcccaccauuuaaguuuuaaguguaguugaauuguauuagacgcugauacugagcauggaagauuuguuuuuacaaagcagggguuuggcaacaugccaguagcuuacuuauuaguuuuugcaaucuuagacaaacuauuuaaccucaguuuuauuauucugaaguugagaccaaaacugucuugaaagaaccuguaagguaccaacaugaauuuaaaaugcaagugcauaauauauagggagguagcaguuguucauuuuuacuuaucuggaauaacuucucuagaaguuucuaucuucuaauuguggagaacaucucugcuccacugucuguccuuguggccuaaauacauuugccucauucuuuaggacgugauucagcaugugacccuuaccugguccagaauucuugcucagaguuuggaaaacgcaugcaccuauccucaagguuacucugcuguagauguuaacuuacuguaacuggggacuauuuuugccaugugugggugagcccaccuaugcaggaagccaucacagagcaaagcagagccuacacuguccaugggcuguccugauggugucaguuuagauuccacgucuuuuguuauucaaacuagacuuggcccauaaguuugcuuuucuucuucuucuucuccuucuucuccuucuucuccuccucuuccuccuccuccuccuccucccucuucuucuucuucuucuucuucuucuucuucuucuucuucuucuucuucuucuucuucuucuucuucuucuucuucuucuucuucuucuucuucuucuuccucuucuucuucugucucuccuucaaaguaguuuuugcugaguuuugguuacuuuuauccaaagggucucuuaacuaguaugacuagaauaaacuaaaugucaaagguaauuuauuuguccugggacauuuucugaggcagaggcuaagggcugauuuuccuagaagaauaaaaccuuccucacccuaacugaaaacaaaauaagaacuugguaccucaaucauagacacucuugugaugacagaugagauauaaauuggaagccucuuaugugaaccccaguagagagauaguauccaucauuuuaggucuguugguggagacaauagguuguuuuuaauguuaggaaacauucaaggacacaguacaguuuuuaaaugaauacauuucuauauuccaaaauauaacaagcuucuauuuucacugcagaucuagaauaucuuucuauuucuagucaaaugccacauugucaaaaggauauuucuucccauggcacuaaugagucaucuguaauuuuaagaacauaagaggggagacguuuucugaacaaagagugggugaagcugaauguauaggcaaaugguacaguaguagcucaaguuaugaaaccgacaaaaaaaaagucccauaagaaaaaauuguacucacaaacugaaauguccuuguuacacaaagugaaggaacaaauagaaaguauucagcuucgacucauaccuuaaagguccccugaggacagcaaccaugagauggaaacucagugcauugcaacuuugcuaucuccuuuccacuucacgguuguuacuguuucuuucauugcuaauaaaggaucucugaucacagcuuaaaucacuuuaauaauuuuaguagaacauuugauuauuacauaauuugcagaucagaaacugggucaaagaggauaaaaauaugugggcauaugucacgauaacauauaccacugucagugacauuuccacuagcccaauggcauugguuaucuuuauaaaaagaacacagagagcccuggcaugcuacagugccuucacacagcacucugcacauauggugcaccugcacuuuagccugagguauaccauaaagaauacauucuguaaccauugucauggucaaugcuauuguucaauauuugcccuucccaaaacucauaaauugaauuauuccauaauacaaggugggaauauuuaacagguuauugguuaaugaaggcuuugccuucaagaaugaauuggugccuuuccaggguaagauaauagacccuucuugcuccuccuugccuuaaacccuuccaccaugugaugguuuaguuccucaaucuuggacucucuggucuccauaaguuuaagccaauccauuucuuuucauuauaauuccaaauguuggaugugauguuacagcaggcuaaagggucuuagagauuuggcuuuuuaaaaucauuuuacauauugcuaauaaaugagcaugaugauuuauauaaaaauaacucauuaaauaaguucaaucuaagggaagccauugauguuugcauauuucaacucaaucuucaaaacaaauccauauucacaguuuuuuucagucauggagaaucucacccuuaaugauuuuugaccaguagaccccuuggcugcuucaacucauucacuuuuccccucccuucuacccuccuucccucuaugucucccauucucucucucucauucauauauauaugaaggcuacauaguagucacuaaaacaaaauuagugaucaaauauuagaagaaauauucuuuuaaaagacugagauuuuuacuaagcaacuucaauguaaaucagagaaaacuuaauguuuaugaagauuauaccauaagaaaacaaucuauuuaugagagaaaauuuaagaccaguaacauaauauacaggcaaccuaaagaagguuuuaaaacagagcacuaugaaagaaggcaacauucugaauguggcuuggccauguguucuaaaguacucuaugcuggacaagcugacacauuccuacaaucccugcaccuguagaaaggaggagugugaguucaaggccagccugggauacauagggaauugcugucucaaaaacuaaagaaugaagcacauagcgugucuguuuaaaaaacaaacaaaaaacaaacaaacaaacaaaaaaaucuuagcucuagaaaugucuaccugcgcugcuauccaguggcucacaucuggagaucuguuugguggaagaauaaugugaaaaugaaggacaugccuuucauuggaaaaacuccuuccugauaacaauaucucuccuaucagguuguucugcuugcacaaugugauuuguuccaaaaugucugaauguuuuuccuucuucacacaaugugcauuugaagauaaggacagcugaugucaaaggcagguugggggcagggguaggaaagcugaucuggcugccaagucaucagagcugggcuuacaccuugagcuuuuuguaaaagcuuuaaguauuugucacuggguuaugugauuuuguuuuccauuuuccuuuaugccauuguuuuuaaaauuuuaaauucaaaauaacccagucagggaccaucauggguagaaccaccccucaaaacaguaucuuucaucaauuuaaaagcucuuuguuuuugaaaacauauucuuuugcuuuuauuuuuauuauuuguugauugguugauugauuuuauuuuauuuuuuuaagacagagucuuacuauuaacuuuggauggccuggaacuugcuauuuaaaucaggcuagccuuaaacucacagugacucuccucccucugccuccuaauugcugggauuaaagguguguacaaccaggccugguagucuggaagcucuuuaauuuaaaagacaaaaaaaaaaaaaaaaaaaaaaaaaggaucugauaguuugauaguuuguauggugauuugaguaagaauggcucucauaaacugaaauaauugaaugcucaguaaucaggggagugguauuacuugagaaggauuagaagguguggcuugacauaguuauggcuuugauggaggaagggugccauggaagagggcuuugagguuuccaaagcucaggcuaggccaggcccagugguucucucuuccugcugccuguagguccagauauaaaacucuuagcuacuucuucagcaccaugucugccugagugcugccaugcucccagccauaaugauaauggucuaaaccucugaaugugagcaagcuccaaauaaaugcuuucuuuuuauaagaguugcuguggucauggugucuuuucauagcaauauaacacuaugacagucugguuaccacauagugaauuacuaugcuuuuuaaaguguuuccauuuggucuuuuauuccuuuauagauuuauaaauaaggacaucguauaggggcugggauacuggauuucaauuuuguauuuugacagggccuccucuuaguaauuuuuaucauuaauaaaucacuuuuauuuaucuuuguuucuauauaaauaaauaguaacuauuaggugguggauuuggucuguaaauuggaggugccauguuugggggaguaaauaccugaugaggaaaaggcuuucuaaccuggaccauaggagccucugaaacacugcaugcccccccgagaauuguaaguaaauaaacacaauccaugagaugaaccaauuucuauguggaacacaucuggaucuuuauuuuguaauuuccucauauucacuucugacaaauagcaauuauagaaugaacaaucuccuaaauugacuacuuuuaugucaccuugacauaagcuacagucauuuuggaaaagggaaccucaguugggaaaaugccccuucucuagauuggccuggaagcaagccugaagugccuuuacuugacugaugauugauguggcauggccuagccuguuguuguagugccacccccaggaggguggucccaggugcuauaaaaaaaauaggccaagcaagccagugagcgugcucuucccccgcuccugcuucaguuccugauuccagguuccugccuugauuuucugccccagcuuucuucauaauggauugugauguagaacgguaagcugaaauaaaucuucccuaccuucaaguugucuuggguguggauguuuuaucccaagaauagaaacucuaacuaagacauuucucucaccccaagcuaccacauauggcagcuuuuguccugacaggaacugggcuaacaguacagugucccuaaaaguuuggaguauuuuaggauucguggucaaugaaacacuugacuugcuugguuauauauucccccaacuuuaacaacuggcaaguguaauuggcuagauagugucuucaaaaaguucaagccaguaugaaacuguaucaaucuuagaaacagagucuuuguagacauaauaugguuaugauauauaugcauauauacauauacguacauacauacauauaugugcugaaaugguugaauugcaauaugcccccaacaauccuauauaugugaacuauaagccaaaagaaaucauuuuccccuaaaaacaagcaacaaaacaacaauaacacaaaauacccauguauauugcauaacuguauuccauguggaaacgauuacuuaggaaguuauuuauuauuuauaauauggcauagaaauaaaaaccucuuguguuguaaaacuuccuuccaugagaaauucacacaauauauuuuuaggucuuugguaacucagggugacuucaacauuucaagguacaaaaaaaguacuuaaaauugcuuaguccuuguaaucuucagugagaguuuuuuuuuaauuuguuaaauuagcugccuacaaaaucuuauacguauauuuagauuucugucauggggcauuuggggcagcuccauaugguauaauauaauuuauuuacuucuuaugaauaugcauaaaccacccaccaaucuggucucauuucuuaagcagagggauuguuaagccugugcuacuuuaguaugugagguuucuguaacaguccaauguaaauguaguuaguggcaaaguauaccugauaaaaacacuuaccuucuuauugauauaguagggguccagguccuccagaggcuccgacaccaucucuggaggaaugucuccauagauaaauggaagguucuucccagcuuccaagucacuguuuggcuuugggccauuuucaucaucaucuuuuuugucuggcuugggauucuuagccuucucuucugcaaugcgccuuucaauagcugcaagggauucucuggugaagaaguugaagcugucagguccuggugguacaagcacuguuugcuccaucuugucauccugcacauuuuaauuacucuuuacucuucaugugagauuccuaaggagggaagaaccagaaacguggagaacauuaaaaguuaucaauaucaauaaauacucaucuagaaaagugggccagaagacuuaaauuuuuuucuccuccaaaauuuaaauggaaaaaauaaaaaaaauguuuacacaaauucauucucuauguugagcuuuggccaagcauucuuguauguuuaggauugugcuuuaccaauagaggaacuaggcugugaguuuaaacacugguucaguauugcucugaguacauuuugauaauugucgccacaucacugauaaacuguucacucugagauguaccuguaugaugaagacgaugcccacugauagaucaaucaauucaaagguaucacacacacacacacacacacacacacacacacacacacacacacacaaccaaaaaaaaaaaaaaaaccggaaccuugucucugagaucuaaaaugcagccauugaggcuuaacaaguaaggacaaagcaguuuaacuuuguugcagucaaucagaaucacauaaaaagacagucauugcuacacuacuuaugccuguguacacccugagaugugggugaauagaucuauggccugagaacuacauuagcucuaguagagucucuuugacaaugacaauccaaggugggacaaaugccauuaauauggcugagauggacauaaacuaaacuggaaaggaagcuaugugcacaggagguaguagaaauguucuuaguucaaggaacaauguacuuuucuucaccgaaacaauucugauacaugggagagucugcaguccugcagauauuaaggccaaauccaagaugcauccuuuuaaagguauacuuaauaagaacucaaauuucacacauauaucugugcccaaacuucccagagcucaaguucugccugguacagacucuguuuuaauagucuguuagcucauuaaagucagcaagcucaauacaauuaguugcagcuuugaugucuaggucucuaauagaaaacuacagcuuccucuuccucuccucccaguguucucccuccccccauucaccuuuccauuucuucucagagaaagugaaaccucccauugauaucaacccuccucccccaaccuuggcauauuaagauguauaagacuagacauaucuucuucuauugacacuagacaaagcuguccaauuagggggaagggauccaaagucaaccaauagagucugagagagccccugcucuugcugauagagaucucacaugaggaccaagcuguuaagcucuuacauaugaauagcgggucaucccaugcaugaugucuuguuggugguucaguaucugugaguugcuaugcgaccagguuaguugauucuguaggaucucuuguguucuggaucucccuggcucuuccucucccucuuugacaagauuccaagguuuaccuaauguuuggcugugggauucugcauguauuuucauuagcugcugcaugaagccacucaaaugaauguuaugcuagccuccugucugcaagaacagcaguauguaauuaauagugccagaggugggcucccucucaaugcaauggaaucacuguauuuuaucucacucauucauucagaucauccugucuagguaucccucucaccuacuugaugguuuugagucuaaaugugcauugaauucuaucuuaguguguuuauuuguucuucuccuuuuuuuucucuuauucuauaaacccuaucuuuugguuuguuuaugacuguugaguuuggaucucagcaugcaccaaagguggaguggaacuugcuccauggcucauacuggcuuugaaauugcaauuaucauguuauacuuuccuaauuguuuggauuguggucuugcaccaccaucucugauuuuauucuaucaauucuagugcugauucuacuuauuugauguguagauaauacuuaugaucugauauuuggaagugaacugaacuauuuacagccuuaugucacuuaaaagcaugaguauauauugagaaaaaaaucaguagaugauuuuaauguggaaacauaauagaauacuuaaauggacuuacguaguauagacaaaucacucaacauuaaugcaucaaagaguccaauauucacgagacguaugaagcugcuaucagcacaguguggccugcucuuuuauuaccuuaaacaucuuuauuaguagaaauauacucuaaaauaugauuaaaaagaauauuauagaaaauccacaaacucuugacagagcugcuguuaucaucaucgaguguuaugauacaagcauaauugaaaggcugccaugaucuaugggacuggcagcagaagaugucuguggaugccaccauuaccucacauguccuguguugugccaugaguuuaggauggauacaugaauaaguauugggacuucuaagcuccacucauggagccagcuuugaguugcaaucugucugugaccaaggcaccagugugcagugcuugauaauccugccgagcacauagaucuuugcuucucucucucucucucucucucucucucucucucucucucucucucucucucucucucucucugucucucucucucucucucucucucuuuacugagaacaaacguaaacacauauauaagggcauuuguuuguuuguuuuuucucguuuguauuucuuugcuguuucauagguuuagcauuaucuuuuguaugcaaauauuuaaauuuuggauugcagcauaauuuaaauacauacuaauugcauacaauuucagucuuucugaaagggugcaacaacaggguccauuuuucauaaaauuguguggacagaacagaaguggcuacuucaagccuuccuauucaguaaaaaugagcaacccacaagaccuaacaguauuauggugugcuuacagccaggagccuagcaugucuacccucagagaggcccaaaaagcagcugacugagacagaagcagaaacuuacacccaaccaauugucugaagucagggaccccugugguugaauuaggaaaaggcugggagaaguugaggaggagggcgaccccauaggaagaccagcaggcucaauaagccuaggcucuugagaucucucagacacugagccaccaaccaggcagcauauacuagcucauccaagguccuggacacauguacaaguaggacuuccuggucuggccucagugagaaaagagccccuagcucuugagagaccuggggcugcagggaauggagagaccuggcagggguguuggggggagugugggguguggagaccccuuagagaugggggugggaggguggggaggagaaaugggaugaggaacugucugagggcagaaugggagggggauaacaacuugacuauaaaagaaaaauauuaaauauaauuaaauauaaauaaaaagcaguauaagaaaaaaugaaaaaaaaaaaaaaccuuagggcuauuggcugucaguaucaacugaguaaacaaacagccaaaaagauaggcaaauacuacugaugaauaugaccacuucaaauuuauuguuauaauaaugaccugguucaguuacaguaauuacacucauaugugaguaauuuaacuaaauacuauacugauaacauauucagguuagggggaaaguauuucuuacuuucugauuagaccuuguauucaaauacuaccaaaaaguaaaacauaaguuauauuaauuauaagaauaauaccauuucaagauugugaucuggggcuaaagagauggcuuugcuaaaggugccuguucaugccuggugaccuugagcuugcugucugccccacaggguggauggagaugacugauuccugugaguucuccucuaagcuccaccaugccacuuuuccaucucccucccucucucugucucucucugucucucucucuuaaacaaacacacagguacacacacgcacacacagauacuagcuaaguaaacaaauaacuguaauuuuaagcaugaugaccuguuccauaagguugcuuaugaaauaucugaagcugucaaauauccuucaauauuaauguuuucaagcaauauuaugggcaaaaaucuauagauuuuaguuugaacuucuacuuucucuauccagaaauaaccauuaggauagaaagaaaaaguuuggauuuuuaacuuaaaauuuuuaaacauuuaaacugaaaacugagaaugguccccauuuguggaaacacaugccucauuagagaugucucauuugaggaccauguggcuugaggcuuguggcggucucuuuacuuuagugugacuuuggaugccuugguuacauagagcagcccguguacccuucaguagagauagccaacaaaucgugguaagaaaagugucaaagagagaguaauauuuuaaagaaaaauauaagauaagaacuuauucaaaaugcaaacucacauaguuaugaagaaagaaaaaugaugcauuucauuaacagacauacuuaaaauaauaaaaagaaguaaauugccaagaaaaaaaugaauuauucuuuuagaaaauacuuuuaaaaauuaaauauagacaagucauucgaaagaaggcaacaagaaacaguaaaaucuccuaaagacacuggaauagaagugaggaccugagggcuggagggauggcucagagguuaagcgcacugacuguucuucuagagggucugaguucaauucccagcaaccacauagugucuuauaaccucuguaaugggaacuggugugucugaagugaauaccacauauguacucacauacauaaaaugaguaaaucuuuugaaaaaaauaagugaggaaaacauuuaaaacuaauaaaaauuuaauucacaaugggaaaaacagggaugaaagagaaauaagaaugaauuacuucauucaaauaggaaccuucuggcuuuaucgucaccaacaauucauacuuuaucgucaccaacaauucauacuuuauuucuauaacuuuuaaauguuuuucuaaaccugguaaucccagcuaucaguuaauaugguuauucaauaucaguacaucuuagcuauauuaugccacauaauuuuaugugugaagcaaugcuauauguguagugucuucuaaaauagcaugguauuuauagugaaaauuagcuggauucuugcuaacaugauggucagcuccugcaagccuuaccacuauuuugaggacaucaguccucuagauagcacccuucuuaauuaaauuuuuggucuacuuugcaaaauauucuacugccaaaaauuaaagucaggugaaauauuauucuuauugauauuaucucacaaaaauaacuaaaauauuuauuaguguguguguaugugugugugugugugccugugugugcacaagugcauuaaguguguauauggagacuugugcggggcauaaaacuggaggucagagagcaacuuugaagagcugcuucuuucuuuguaauuuuauguaaauuccuaggauuaaacucuagucaacaagugucuuugcccacugagccaucucccugaucacuuaaccacugacuaauucuauaaggcuugcauuguacuuagugcauucuuuguucuugaaucaaaaaccaaaaccaaagggacacaaauugaaaaggaagaugucaaaauaucacuauuugcagaugauaugaucguauaguuaagugaucccuaaaauucuaccagagaucuccuaaacccgauaaacaacuucaacaaaguggcuggauuauaaaauuaacucaaacaaaucaguagccuuccucuacucaaaggauaaacaggcugagaaagaaauuagggaaacgacacccuucacaauaguuacaaguaauauaaaauauguuggugugacacuaaccaagcaagugaaagaucuguauggcaaaacuuuaaaucccugaagaaagaaauugaagaagauggaaaaaucuuucaugcucaugauuggcaacauuaauuuaguaacaagggacaucuugcugaaagcagucuacagacucaauggaauccccauaaaauucccacucaauucuucauagaguuagagcaauuucaaaugcauuuggaauaaccaaaaacccagaauaaugaaaauuauucucgacaauaaaagaacuucuggggggaaucaccaucccugaucucaagcuguacugcagagcaauugugauuuaaaacugcauaguaaugguacagugaugggcaggaagaucaauggaauagaauugaagauccagaaaugaaacccaccuaccuaugguuacuugaucuuugacaaaggagcuaaaaccauccaauggaaaaaagcauuuucaacaaauggugcugguucaacuggcaguaagcauguagaagaauacacauugaucuguucuuaucuccuuguacaaaacacaaguccaaguggaccaaggacuuccauuuaaaacaagauacacuaaaguuaauagaagagaaaguggggaagagccuugaacacauggacacaggggaaauuuucuuaaacagaacaucaauggcuuaugcucuaagaucaacaauugacaaaugauaucucauaaaaucgcaaaacuucucuaaggcaaaggacacuguuaauaggacaaaaggcaaccaacaaauugggaaaagaucuuuacuaauccuaaauccaauagagggcuguuaucuaauacauacaaagaacucaagaaguuagacucccuuuacuacagagcaauugugauaaaaacagcaugguacugguauagagacagacaaguagaccaauggaauagaauugaagacccagaaaugaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacaucuuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuggaaaucagucuggcgguuccucagaaaauuggacauaguacuacuggaggauccagcaauaccucuccugggcauauauccagaagaugccccaacugguaagaaggacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaaggaacucacacaauauguacucacugauaaguggauauuagccccaaaccuaggauacccaagauauaagauacaauuugcuaaacacaugaaacucaagaagaaugaagacugaaguguggacacuaugccccuccuuagaauugggaacaaaacacacauggaaggaguuacaaagacaaaguuuggagcugagaugaaaggauggaccauguagagacugccauauccagggauccaccccauaaucagcauccaaacgcuaacaccauugcauauacuagcaagauuuuaucgaaaggacccagauguagcugucucuugugagacuaugccggggccuagcaaacacagaaguggaugcucauagucagcuaauggauggaucacagggcucccaauggaggagcuagagaaaguauccaaggagcuaaaaggaucugcaacccuauagguggaacaacauuaugaacuaaccaguaccccggagcucuugacucuagcugcauauguaucaaaagauggccuagucggccaucacuggaaagaaaggcccauuggacacgcaaacuuuauaugccccaguacaggggaacgccagggccaaaaagggggaguggguggguaggggaguggggguggguggguaugggggacuuuugguauagcauuggaaauguaaaugagguaaauaccuaauaaaaauggaaaaaaaaaagaaagcucagcacuacaaaaaaaaaaaaaaaaaaaaaaaaaaaaagaaguuagacuccagagaaccaaauaacccuauuaaaaaucggguacagagcuaaagaauucucaacugaggaaucccaaaugguagagaagcaccuaaagaaauguucaauccgggcguggagaagcacgccuuuaaucccagcaccugggaggcagaggcaggcagauuucugaggucaaggccagccuggucuacagagugaguuccaggacagccagggugauacagagaaacccugucccaaaaaaccaaaaggaaaaagaaaagaaaagaaaagaaaagagaagagaagagaagagaagagaagagaagagaagaaaagaaaagaaaagaaaagaaaagaaaagaaauguucagcauucuuagucaucagggaaaugcaaaucaaaacaacccugagauuccaccucacaccagugagaauggcuaagaccaaaaacucagguuacagcagaugcuggugaggauguggagaaagaggaacacucuuucauugcuggugggauugcaagcugguaaaaccacucuggaaaucagucuguugguuccucagaaaauuggacauaagacuaccugaggacccagcuauaccacuccugggcauauacccaaaagauacuacaacauauaacaaagacacauguuccacuauguuuauagcagccuuacuuauaauagccagaagcuggaaagaacccagaugucccucaacagaugaauggaaaauugguacauuuacacaauggaguacuacucagcaauuaaaaacaaugacuugaugaaauucuuaggcaaaugaauggaucuggaggauaucauccuaagugagguaacccagcuacaaaagaaccacaagguaugcacucacugguaaguggauauuagaccaaaaguucccaauacccaagauacaauucacagaucacaugaaguucaagaagaaggaagaugaaagugugaaugcuucaguacuucuuagaagggggaacaaaauauucaugggagguagaggguaggggugacuugggaggaagagaggaagaggagggggaaagggaggcaggauuaguuaugagaggagauggggaugauauacagaggggcaggaauuugaacagagguguguagcaaugggggauagggaauuggggauauccaucagcaagucccagaugccagcaaagauuggggggaaugagaccacccacucaucucaaaauucuuaacccaaaaggguuuucuugucuaaaggaaauacggggacaaaguguggagcagagacugaaggaaaggcuauccagagacugccucaccuggggacccaacccauagacagacacuaaacccaaacacuauuguagaugcuaagaaguacuugcugacagaagccuguuauagcuguccccugagaggcucugccagagccugacaaauacagaagaugcuugcagccaaccauuggacuuagcacagggucucugacguaggaguuggagaaaggacugaaggagcugaaggggcuugcaaccccauagggagaacaacaauaucaaucaaccagaccucccugccccagagcucccaggaacuaaaccaccaaccaaagaguauacuuggagagguccauggcucuagcugcauauguagcagaggauggcacugucugguaucaauaggaggagaagcccuugauccugugaaggcuugauuuuccaguguaggggaaugccagaucaauaaggugguagugggaacauucuaauagaagcggagggaguagggaugggagaggaaaccagaaaaggggauaacauuugaaaaguaaauacauaaaaauccaauaaaaaaguagacaacaaacuaaaacaacaacaucaaaagaaagaaaggaagaaagaaagaaggaaagaaagaaagaaagaaagaaagaaagaaagaaagaagaaaaaagaaaagaaagagaacaaaauuuuuuuuuuuuaggucaggaucucuuuuccuaacccugacuguccuggaauucauuguccagaucaggcuggccuugaauucacaguggccuuccuuugccuccugagugcugagauuaaaggugugcaccaucauacccauccucaaaagcuauuuugacagaauaaagugcugauauguucucagaucaagagccuaaaaaccauuaggaaauucuuuauauacuaucaauuuuugagaaauauacauuuguauaagcucuguuuuuauuuguggauguauauauguauuuuuucuguguuauuucuauuauguagucuuuacuugcuugaaguuucaguuuaaugauaaaugcccucuucucucuugaaagugucuuaaauguaucucaaauaugaugccaaauauucugguguaggggagagaaugauauggaugagcagugagagucuuuagguugguaaggagauugcagggucauaaacaggaugacacagucuaacagggcaauacacccagaugaaagguguagcccagauuaaagguguguuccuuaaacucggagauucaaucuucuggaauccauugccacuauggcucaagaucuucaaaccaagauccagauaaggaucuccaagccuccaaauaagggucacuggugagccuuccaauuccggauuguaguucauuccaaauauugucaaguugacaaccaggaauagccacuacaauccaccccuugucaacuugacacaaauaauaucucauguucacaugaaacaauaacaagguuguaaauaugccuaacaugauauaacuaucucucguacaaucgcaaaugcauuaguaaauuuacaaugggcauucacuaaaaagacagagaggccaagacggguuugaugaggugaaguggcacuucuugauauucagucggggcugauacccaaauauccacuuaguuggaggagaauuauucaccuggguguuuaaccugcaggccuccccaaccaguggaaauccugcuaugcucuucuugcccuuguauaauuuugaguaauagacuuuugugcugauggaaugagacuuauaaacucuagucaagcuuucucugaagcacugugugucuacauagccucaugcucuagguccuuugcucugagaaugguauaucucaaaugggugcuucuuccucagucuggauccuggaauaagaagacacauucacuggaugucaagagaaagcuaauaggacucaaagggucuaaaaguaacgauuuaucagugauguuugacagugauauuacuaacgagcaaguguaugccauugaucaaagaccaggcugcuaaaugaguugaauuaauuaggaauauuugucucucagacacaaauguugccagagauuagauauuccacaccucaugagucuccaccuauaguucuagaugaggaacacauuaucauuaggcaaucagugaaaucauggccuucuaacaaucauauagcaacucaggaaaauuuguucaaaggaugcuaaauagccuauaucaagaauacaaagagugggcuggggaguaguucauuaguaaagcaguugccauguaagcauggauaucuauguucagaucuucaguacccauugaaaaagcugcagcaucauccaaugccuagaauuccagugcuggaggagcagagacaggggcaucaugugggccuacugcccugacaguccagcugaaucaagaauuuuagguucagugagagaucaugucacaaaaacuaagguagaaagcaacagagaaagaagugugauauuuaucucuggucucucuaugcacaagaacacacacacaugcucauacacaaacacuccacacuccuggguauauacaugucuacacucaugagcacauacaugcauaggcacaagcacacacucccaaacagggauacauacaaaaacacacaacaaagaauauguauuaucaaucagaagccaauuauuuaaguuaaguaguaaaaaauucuucuacuaaaaagacaaccguaccauggugaggaaaugguccagucaaugauauuugcuagaacugucauuguccauccaugugucuaugcugcagcauuuaagauaucaagaaggagcuggccuagugagaacagaaaaucuaacauggcugcuauagcuuacugacuagaaguuaagugcacacuuccuaaaagaaggcuuugacacaagccacuucaguucccuccucauuuucuuguccccauuccucucucuguagaauucugagauuucaauucaguuuuauacagaaaccacauuacuguaagcccuacaaaguuauggcaauauagcuauauggagucaaguaauguagguuauuuuuuucccaauggugcuggugaagguggcaauuauguagcuauacuuagcagacugaggaaauucugcuagagucagcauuugucucuucauugcuaugaaacaguaauggaaaaauaaacaaaaacaaaaggcaaacacuaugcauaauucccucagaucauauuaacaugugauguuggaguaaauuguuauaaccccauuuuggaaauacuuaccuuaauuaacuaugauuuccuuaaaauaaugcaguauuuacaaucuauaugaaagcacuauaugggacacaugguaugauggaacagugcacccaagagacaccaagaacauuccugucuguggcagucuuuucucuauacagaggcauuuagucucaauugcucagaguuauuuuacguuuucagugacuuucacuguucauucgugugcauauugccuggacaacacaggaugaaaaaugguccaagagaagucuuugacuugcuaaagcaagaaagauguuuaaaauaugcgacacaugaaauaucccaaaaaguguagaauucuuuuugagaauguugaugucucuuuagcauaaagcuaauuugaagguguccuucuuauccuaauauuuucuuacaaaaccagcucaucucaaagcaaaaguguucaagauauaguugauggaguaaggaguuuagcacacagaacacagggacagcuacagagaaacagcaaauagccaaggcagacauaaagaggcugacaagacaugagagagaagaguauuaaacacagaucagcuaccuggaaaauggcucucugguguuccacacuuccucucaucuggaugaucuagaaacacaguaacugcucugaguuaagaaagccugagaccagcaguguguggguggccugcauuaaguugauugauaaacauucuacauauaaaaucuguacccuucacaaguuuggucaaugacacaauucuauuguaauaccauagacucauguucaaagaagaaucauuuaaggacagagugugcugaaagaauguauaggaaauaagucacaaaagaugacauaauuucuugauuuaaaaccucacaggaucauaggaucagaggugaggaggacacaacaucugucaaaacacaggaauuaacuaggaccaaugggacccaggcacacaggaacuccaccagaucaguggcacaaguuccuucuggucugucugggucagugcccugagcagaccuugggcuugaacuucacagccagucccacaacacccagaggaagcuccacucccaagugcucuaacaugccgaggaucacaggaucacagaagcuuggucacaccaggaucucagggucccagaggcagcuuaacucccaggagcucugacccauucaggaucccagaaccacaggaucacagagacagcuugauucugaggaguucugacacaaccaguaucacaggaaggaugagcuccagucagauauagccagauauaucagguagcacuagagauaaucagauggugggaggcaagcauaagaacauaagcaacagaaaccaaauuuacuuggcaucaucagaacccaauucucccaccauagcaaguuuggauacaccaucacaccggaaaagcaagauucagaccuaaaaucacuucucaugaugaugauagaagacuuuaagaaggacauaaauaacucacuuaaagaaauacaguuaagcagguagaaguccguaaagaggaaacacaaaaaucccuuaaagaauuacaggaaaacacaauugaacaggugaaagaaacaaacaaacccuccaggaucuaaaaacaauaaagaaaucacaaagggagacagcucuggagauugaaaaccuaggaaagagauaaggagucauagaugcaagcaucaccaacugaauacaagagauagaagagagaaucucaggugcagaagauaccauagaaaacauugacacaacaaucaaagaaaagacaaaaagcaaaaagcuaauccaaaacauccaggaaaucaaggacacaaugagaagaccaaauuuaaggauaauagguauagcagagagugacguguuccaacuuaaagagccaguaaauaucuucaacaaaauuauagaagaaaaauucccuaaagaaagagaugcccacaaacauacaagaagccuacagaacuccaaauagacuggaccagaaaagaauuuccuccagucacauaaucaaaacaccaaaugcacuaaacaaagaaagaauuuuaaaagcaguaagggaaaaaggucaaguaacauauaaaggcagagcuaucagaauuacagaagucuucucaccagagacuaugaaagcuagaagauccugggcagaugucauucagacucuaagagaacacaaaugucaacccaggcuacuauacccagcaaaacucucaauuaccauagaugaagaaacgaagauauuccaugacaaaaccaaauuuacacaauaccuuuccacaaauccagcccuagaaaagauaauagauggaaaacaccaacacaaggagugaaacuacacccuagaaaaagcaagaaaguaaucuuucaacaaacggacacaaacauaauuccaccuuuaacaacaaaaauaacaggaauuaacaaucacuuuuccuuaauaucucuuaauaugaaaauuaauauuaccaacauaucuuaaugaauugaaauucaaauauaugaggaauuagaaauuugucggcugucuuccaguggucucucuaauuugguaaugggagaaauagguccaauauuauacaauccauauacacuuucugcuuguuuguauaugacaaagucuagcuguguaccacacaauggucuugaaaucaugcuucuccuaucucagcauaucuauuuguaggauuguuuauuuaauguuuuuacacuacucuaugguuuucagaacagcuuacauauuucaaaaucauguauacagcccaaagaaauauagaaaauuaauuugggagguagcuuguaagagaacaacaaagagugagacugaacuuuuuuuugauauuuauaauuauuguaucaauuuugaagaagaggaccuuauaaguuacuuuuuuucugauaugaauguuuuucagaauuaucacagucaaaggaaccagaaucuuacacucaccuaaugucugugccacccuccaagcagagccauuguucauugaaacaauugaugaaugacuccauggauagaccaucuuaauacacaccauuucuuaaaugaauguaaccugcucccuguaggcugagaaugaugacaaucacucaagucaaauaguuuugauuauagaaggaaauauguauccaaauaaucgugccugcaauucauuccuuggugcagcagaacugucaacucuuagcuuaacuacuauggagguaaaauccuuuggugaugugagggacauugaaguacagacuaauuacaaugaacuccaauaucuaaaaauuguucuuauuuuggguuuguaccacaguaagagucaagauuuuaaagcucuacuaaaaacaaaacaaacaaguaaacaaaaugacuuuauuuauguucauuuaauaacaugucgaucauuuuaugauugguauaaaaauauauauugugcugaauaugauaaaaaauuaguucacuuaaaaauaaaauaaagacucacuauuuuaauugccucuaugcagcauuuaucauauaugauaucaaauuacaucuaauuuauuauucaaaacuauacugguuagcuuucaaucugacaguuaaagucagucaaccaguguuucuuuugugauguacuggacugauuuauagagacccuucugggauucuuagcuuucuguguggucaccagcuaaugacugucagcucuguacaaaggacacacuaccagaugccaggacaucugucacagcagcuaggacacagagccaaaucuauucuugucuugauguaugacacacaauauguacaaucaguuuuguucauuuugaaaguauucuuuaauauaugcuacagacaagacccugcaggacagugaagaccguacgguggcagggggaguggaaaauaacauaguauugggaucuugagacuaaagcaauuuucuucacaagauucuuuaugaaaucagcucugagauuuugauuuguuuuggaauuuugauguuucugaccuuaauggagugauguauuagucccagaauaggugaaaaugaagguuaaacauuuuuggcaucaacuuaaaauacagaaaaccucuuuugacuucuugagucuguuuguaugugugugugugugugugugugugugugugugugugugugugugugugucugugugugugugugucugugucugucugucugccuaugcaucugugaaaaggcaaggagcaguaacacuauccugaauuauuacuaauuuauuuaaagguaaaagaauaaacaucauguaaccucucuuaauaaaucucacauaaagugguuuuuuuucuaacaauagauucacauuuuaauucuuauuucaauuaaagaacuuuugaugcauuaagcucaaaaccauaaacaugucagauaacagaacauuaaguucaaggaauauccuacacucuuuaguucuaacuaguuuugaaguuauguuccuuuuucucauagaucaaauggugaaaaacuauaaaauaguacuauuaauauacauaugagagauuugguuucugaaucuaugccuuuucuccuacucagcaugucuucuaacauuuuuuggcuauuuuuuuauugguuauuuuauuuauuuacauuucaaauguuauccccuuuccugguuuccccucaggaaaccuccauucuaucuucuuucccccugcugcuaugagggugcucacccacccacuccugccucacuguccuagcauuucccuacacuguggcauugggccuucauaggaccaagggccuccccuccuccugaugcccaauaaggucauccucugcuacauauguggcuaaagccauggguccaaccaugguugguguuuuagucuuugggagcucugggggucuggcugguuaauauuuuuguucuuccuauggaguugcaaacucauuaagcuccuucgguucaucccuuaacuccucuauuguggucccaaugcucaauccaaugguuggcuacaagcaucuacaucuguauuggucagguucugucagaaccucucaggagacagcuauaucaggcuccugucagcaagcacuucauuggcaucagcaauauagaaaaugugguuacauuuacacaauggaguacuacucagcuauuaaaaacaaggacuucaugaaauucuuaggcaaauggauggaucuagaguauaucauccugagugagguaacccagucauaaaagaacacacauuguaugcacucacugauaaguggauauuaggaauaaagcucagaauacucaagauacaacucacagaccacaggaaacucaagaaggaggaagaccaaaguguggaugcuucaguccuacuuagaagggggaacaaaauaaucacugaagguagagggugggagggacuugggaggaggagagaagggggaagaggaaaaaggaggcaggauccaaaaugggaggagacaggggagauguaguucagaugacaggucaggaguuugaacagagguguguagcaaugggggauggggaacuggggauauccaccacaaagucccagaugccaggaaagcaagaggcucccaggacucuauggggaugaaauuagaugaaauacccaacagaggggagagacaaccuguagagaacacaucugagguuaggcauggcccccauuuaaggauguggcuaccuacccaucucaaacauuuuaaccuagauuuucucuugucuaaaggaaauacagggacauagagugaaacagagacugaaggaaagaccauccagagacugccacacuuaggaauccaucccagaugcagucuucaaacucagacacuauugcuaacauuucuuuuuuguuuguuuuguuuuuugcuuuuuguguuuucaagacagguuuucucuguacagcccuggcuguccuggaacucacuuuguagaccaugcuggccuugaacucagaaauccgccugccucugccuccugagugcugggauuaaaggcgugugccaccacgcccagcucaacauuucuuaacuaugaaaaaaauaacguuuuuguuaugcucaacagcagguggcagcugacaaaguauaauuguaugugguccugaaacauuguaaauaauuuuaauguuauuauaacauucaacaaaaacacccaaauuauuuuuccuucuacuuaaaucucaaaauuaugcuaccaucucuaaucucaacacaauaagugaauucugaagcaacuaagcuagguggggcauuauugguuuuaguuuagaaagcacgcacaguuagucuacuguagcagugcccauuuguggaaauuucugcuccuuucuucauagacuccuggguggaagaaaagugagaccucaacaacagcacuucaucuggaacucaacuuccagaauggagauugaaaaauauaaaucaccaaaaccaaaggggaguuuuaugucagugaguccaugagaguauaaaugaccacaaugacuuaagaaauccucauagaagguaggcaagaugguuugguauauaaaggauacuugcugucaaaucugauuuccagcccuggagaccaaugagugaagaagagaacccucuucuaccagccaguuguccucugaccucugcacaacacacacacacacagggggggggggggagggagagagagagggggagagggagagggagagggagagggagagggagagggagagggagagggagagggagagggagagggagagggagagggagagggagagggagagggagagggagagggagagggaaguguaagaaauucaaaagacauccaaauggguugccagaaaaaaaugcaguuacguuuguauuuguaauaaacaacacuauuuuuguacuucagaauaaauagcaggacaucuagcuauacugauaguuaauuauuguuuauucgaaauucacuuuuaccuggacagcuugcuaauuucuuugacaagucuggcacgcuuacaucugaggaaagucuaccauucuaaaaucucucugcaacuugccugaaauccaguuaacucacuuuagcccuucagcuuaauauaaauugccauuugaaauacacacauaugucugaggcauacaugagcugcucaugcaucaccguaaauuaauuuaaagaaauuuaaaaagacugaugacugauuucuucucaauaucuaauuuuuuuuuuguuaaagaaaauuccugugaagcagcuguaugugcaaagguugugaggcugacuaaaacuuuaaaaacuguggaggguaagggauguugcugaaccaggaagcuuacuucaaguuuccuuggagcuaucuuuuuuuuuuuuuuuuuuuuuuuuuggagaguagauucuuaaaacauccuuaccacaauauauccucccuucacucuucccaucuccucccuacaucuucuccccugcauauccacucccccugcauuucuucuucagaaaagaacuggccuucaagagaguacagaagaaugggacaaagcaagauacaauaagacaaggcaaaagcccgccuauggaggcuggaaagggcagcccaauaggaagaaaagauccccaagagcaggugaaagagucagaaacauacgcacucccaccauuaggagguaccacaaagacaccaaacucacagccauaacacauaagcagaggacccaguaaggaccuacccaaauaucaugccauuuuagucucucugagccccugugagcccugcuuaguugacuccaugagccaauguuuauccucucugacuccuaccaucuuuacccacuucuucuaguucugagggguucuccuagcuuugaagagagagauccaauggagaccuccaauuuaaccucucucucaacacaauguuuuacucuaggucucugcaccuacuccuuuggggccauuuuucuaccuuaaggagacacuccuugcucaacucuauaucaguccuaacauguugauaagcagauuuuaaaaaaauaaauaaacaacaacaacaacaaaaaaaaccaaacaaaaucacuaccacuacaacagcaaaaccuuuguaauguauuaacaaaauuuuauucccaacuaacggaagagcucaguaguuaucagauaacaucugaggccuaucugccuggcugcagucugcuucucugauauacccaccaaugaauuuuaaaauuaccuugauucaugacuuuuacuuuucugcuauuauagaacuuggugaaacaguauccacauuggaacauggaauuaggguaacuuaguacccuguuuguaagccauggccacucaaauuuggcuccaaaguaaacaaucucuuauucccuuugaaugguauauuaguugcuuuucugcugcugugauaaaacacugugaccaaggagaguuacagaaaagggaguuuauucuaguuuaugguuccagagaauuagaguccaagaugguggaaugaaaacaagggagaugaagaaguaacugagcgcucacaucuugagcaacaagcaggaaugacaagcauuuuuuguuugcuugcuugcuuuuggcaaaacaaaacaaacaaauaagaagcucucaaagcccagucccaggaacauacuuauccaggaaggccauaccucuuaugacuccccgagguccccaaguggagacuaaucguucaaaugcuugagguugggaaguguaucucacccaaaucuucaaaaggugggagcucuauuuuuuguaucaauguuugccaugacuaauucgggucugaggauauaggagauuugguuugguuggucugguuuugaaaggggaagaacacaggauugucugugaaauguuaauucaaacucauuuuaacgguucuguucuuauaggauuaucaugugucagggaaugcuacauugaaaacaugaguuuggagaaaugaaaugagauguaaguuaaaagauguaaaguaggggauauauagggcggcaagugugagagcaaauguguaacaugaggacaauaguuaauggaauggugucauagucaagauuuuauaaagaguacuuagcuggccuugucaaaaaaaguaccuauauaaacugauagacacauuuaucuguuucaugacagugaacaauuuuaccauucuguacguauccaauaagaucauauugaugcuuuaaauguacacaguaggaacuacuugccaucaaagaaagaacaauaaguaugacaugauagagcauaagaaagcucuuugacuccauaauuuaacuugaaauaugaagcccucagaaguagagcuguuguagauuaugagaaauguuauaacaggggcaauugauuuucauaaacgauggagaaaguauaauaaccuaguaaacagguauaauuuauuccauaguuugauuuuuuucuaagaggaugauuucucuuagaauaaguucucuuuggagaaugggcaguuauuauuauugauguaauaaaaauaaaauuacucuguguuucuggaggagaagaugaagaagaaaagggugaagaaagaggaggaaggggaaaaggaggaggaggaggaaggggauggggggaugguuacaaggggcaaaauguucacagugaguuuaugggucugugccuuuuuuuuuuuuuuguccacauggaagucuuguuguccacguuggaaaugcagauuucucucugcuccagacauaauggagaugaaugccuauaaguaagagcucugucauuaaacauggaucagacauuccccaggcacaaucuaauagaaaagaaaaacagaaaaacagaaaggagucagaauagggggaucaaucugaagaagaguggagugaaacgguuuggaaaucgaaaaggcaacacaaagaauaaugacaggucagagaaggugacaggcuuaaaagauacaaccaaauaauuccauuuucaugacuccauggugaagaugaaagaagcagaagccguuucaaaagcuaagccaggcaagagacuugggcacugaccccaaggacagucucacagcacucacagguuucaaguccaucucaguucuuggugagacaguggucuuccauugcacaggucuguggcagugaaaauuccuauuuagucacucuaugggaaccagaguguaggcucugaaagaucuugaaagucuauugcuaaaaauugagcuaagaauggaaggcuacgaauuugggaaggagaacuuaggagagcacaacaugggaggaguuagaaagaugagaaggaaggggaacuaugcaaaugcaguauucaccuacaucauuuucaaugaauaaauuuuauuuauuuauuuacuuauuugaagggauuaaaaacaacaacagaauccugagauaaacagggaaagaaagcgcgggggaaaaaccauaacccugagagucuggauuuggccugccacagaccuagaguagaagaggcccaggaaggacaagaugucccauggagagcaggaugcccgcugcugauaaacuacagguucaguuggaagggagcucaguuuaggcaggaaguaagugcauaaggaaagaaagcccuaccauuaguaucugggaauaguucucaucaacugagagcaaaccuuguauggagaacugagucugaaaucaguggguagaugagcagcaugaaccauuucuuugccugauggccacagagccugagaacucaaguuccagccaugaaauacagagcuauauucuacuaguaggcucauugauaaacuuagaaguucuugcaugcaugaagacaggcucuccaucuaucuagaaaaugucuucuauggucacuuagcacaugcccagugcacuugggagauaccucacagcuaagacauuggcuaucucaggggaugcaaucuggauugucucaguggggugacagcauuuucccagcacacagacuuaaaaccuguguacucugauauacaaagggaagccaccaaucugaaaacaacucugguaaccagcagagaguguccaacagagcaucaggaaacuuaaacuacaggcaagacaucagcccacaguuuaaagggcuaugauccccaccaugucauguaacugguaaucuccaauuuucuaggaccuagaaggaauccauuccagcacuucgcacacacaccccuucuuuuuaacucuggggauucuucacuuucccucuugucauuguuaagcuguuagaggcacuuuuauuguagucuuaaaauuugucuuuuauucucaucauuuaauuaucucauuuuguuuaugcauauuuuucauuauuggguaaucuugauuuuuuuuuccuuuuuagagugcuucuucuuauuccuuauccuuuuagaaguauucugaucuuaccuuuuauuauuuuaacuggaauuuuuaaaaaaaauuuuuuuucuaacuucuuacccuguccuauucuucuuuaugauauucaucuccacuugguucguuuuuuccucuuuaaguggucuucacaucucuacucccuuuucugucuccuuccuuaucucuuucacuuacugcauccacauuuaccucaacuaaagaguaugacuagaucuugaaugguuugauguuggugcuguuagagcaguuugcucucuccacucuaacuggaacuggugaccaaacucuccagaguaagcugcuuagccccaugugguggaacauaacugugguuguagaaccgagggggcugaggcaggagcuuagccccgugugguggaacauaacuguaguuguagaaccgagggggcugaggcaggaggaucgggcuuucaggucacacuuugcuacauaguaaguuugcagccagccuccuugugagaugucuccaaacacacagaaacaaaagaggaaaaggagaaaaaaaugacugagguauucaauaugaaauacucaaauaaaacuucaagagaugggacaaaacccaaagguauaagaaguguagcagagaaacucaagaaugugucaaaggaaacaguauuucccccaaaaggucauaauucucggcuucucaaaagacauggagauuuguuaacaucuagaugaagacuucacaaguuuauuugaucaaugaauuccgagaggauacaaacaagcagaugaauucacucuuguauuugcggaggaaagucaacaacacagaagaauaugacagugggacugaugagcaaaacucuaagguacacagaaaaugucagcaacaugaaagaaagauucagaaggaaaauugaguuuuuagggguuuuuuuuguuuuuguuuuuaaaugaagaaaccaaaagaaaacaaacaagccauuggaaaaccacacgacaaaugauuuaaugaaggagaagaaggaauauuacugaaacaacaaaaacccacuaagagaacagacaauaacaaagcaauuuuacaccaacuaaaaaaagaaacaaguaacaaaauuauaggaauuaguaaacaucucucaagaagaauaacauuauauguauauagccagaacucacuaauuaacacagauuggccaccuagaugccuguaugaagacaaauuaacaacaacaaccacaauaaaaacauugacccuguuacuaucuccaaaaaccacaccuuauggguaaagucagccacuguuggagaaugagacaaucuaacaagugagugaaaucugaaaagaauuuagcuguccuacauuuaauaagguagacauuaaaacaaauuagacagaagacauaaagaaggccaagugagcaaugaaagggacaacuaauuaagaugguauauuaauugaggcaggcauggugucacacaccuagcacacgguagacagaagaggccaaucucugugauuuugaggccagucucauuaauaguuccaaaacagagcuacauggaaagacugccucaaaaaggaaaaagagauggaggaggagaaaaaggaggagaaggaggaggaaggagaagaagaagaagaaggagaaggaggagaagaaggagaagaaggagaagaggaggaggaggaggaggaggaggaggaggaggaaggggaagagacaaaacaaccguagauacacaucaaauuuuagaauucuuaauuucauaaaacacuaauggagacaaaauuucagauacacucaaauaauaauaguugauaauuacaauaucauacaauaauuuuuagaugcauuacucaagcugaaggucaauaaagaaauuuaaaauauaaauaggacaaaaugacuuaaaggauauauagagaauauucaauccaacauauguguuuauaaaagauacacauuguucucagccgccuauggaagcuuccuuuaauagguaacaugcuacauggcaaagcaagucuuaaccaauauaaaagaaucaaaauaauuccuuacgucacgucagaucacagaggaggaaaaugagaaaucaacaguaugagaaacuacagaaaauacagaaauacauuauacucuuuuguaugugugugguauauaugugugcauauguucaaguguauguguguguacacuugcauguggauguguaaguccauucauguggaggcuagaggucaaaguaugugugccaggggcucuuucuuagucucuugcucaguuuuuaagacaagucucuuacuaaaccuguggcuuguugauuuggcuagauuggacgggccagcacauucccagcauuucccuuucucugccucugcaaagcuucaguuacaggcaugugcugccccuuuagccauauuauuuagugcuguggauaugaacacagguucucuugccucuuagacuuuauugacagccucuaaaaaggauacuuuugaauaacaaguuggacagugagggagucagagaggaagcuuaaaaauggcuggaaucacaaguaaaaacacacccuaagagaaucuuuggaauagaaaaagcaguucuagaaggaaaguuuguagcucugagugguuauauuaaaaacucagaaagagcugggcaugguggcgcacggcuuuaaucccagcacucgggaggcagaggcaggcagauuucugaguucgaggccggccuggucuacaaagugaguuccaggacagccagggcuauacagagaaacccugucucgaaaaaaccaaaaaaaccaaaaaaccaaaaaauaaaaaaacaaaaacccaaagcucagaaagauuucuccacagugagucacaacuggcuaagguauagagaugaagaaccugcagaauucucagcccaaagggaacauaauuacuguaacccccaccccucaaggcuuagggaugaacacagaagagucuguggugguggaugccgaccacacgaagcauuaucaucugaacacugcagaggcgcuacacauaggaacucaguucuuuuucggcggaguauacagguauauauacuguauauagccagaccaaaucccagcagggagaagggaguugggcacaauccuagccaaacucuggagugauugacaauuguuagcugcgaguauaguguaaccucuccuuaggugaguacucuccaguagaagacaacacaucaaaaggcuuugcaaggcuaaaaagacaauggguacaaaguuacauggauaaagaagugguguugaacccuucucaauagucacaaauaauauaaaauaucuuggcaugacucuaacuaaggaagugaaagaucugugugauaagaacuucaagucucugaagaaagaaauuaaagaucucagaagauggaaagaacucccaugcucauggauuggcaggaucaacauuguaaaaauggcuaucuugccaaaagcaaucuacaaauucaaugcaauccccaucaaaauuccaacucaauucuucaacgaauuagaaagagcaaucugcaaguucaucuggaauaacaaaaaaccuaggauagcaaaaacucuucuuaaggauaaaagaaccucugguggaaucaccaugccugaccuaaagcuuuauuacagcgaaauugugauaaaaaccgcaugguacugguauagugacagacaaguagaccaauggaacagaauugaagacccagaaaugaacccacacaccuauggucacuugaucuucgacaagggagcuaaaaccaucuaguggaagaaagacagcauuuucaacaaauggugcuggcacaaugggugguaauuauguagaagaaugcgaauugauccauuccuauuuccuuguaugaaggucaaaucuaaguggaucaaggaacuccacauaaaaccagagacacugaaacuuauagaggagaaaguggggaaaagccucgaagauaugggcacaggagaaaaauucuugaauagaccagcaauggcuugugcuguaagaucgagaauugacaaaugggaccucaugaaacugcaaagcuucugcaaggcaaaagacaccgucaauaagauaaaaaggccaccaacagauugggaaaugaucuuuaucuaucccaaauuggauaggggacuaauauccaauauauauaaagaacucaagaagguggacuccagaaaaucaaauaaccccauuaaaaauggggcucagagcuaaacaaagaauucucaccugaggaauaccaaauggcugagaaacaccugaaaaaauguucagcauccuuaaucaucagagaaaugcaaaucaaaacaacccugagauuccacuucacaccagucagaauggcuaagaucaaaaauucaggugacagcagaugcuggcgaggauguggagaaagaggaacacuccuucauuguuggugggauugcaagcuuguacaaccacucuggaaaucagucuggcgauuccucagaaaauuggacauaguacuaccggaggaucccacaauaccucuccugggcauauauccagaagaugucccaacugguaagaaggacacaugcuccacuauguucauagcagccuuauuuauaauagccagaagcuggaaagaacccagaugccccucaacagaggaauggauacagaaaaugugguacauuuacacaauggaguacuacucagcuauuaaaaagaaugaauucauaaaauuccuaggcaaaugguuggaccuggagggcaucauccugagugagguaacacaaucacaaaagaacucaaaugauauguacucacugauaaguggauauuagcccagaaacuuaguauacccgagauguaagagacaauuuguaaaacacaugaaacugaagaagaacgaagaccaaaguguggacacuuugccccuucuuagaauuggaaacaaucacccauggaaggaguuacagagacaaaguuuggagcugagacaaaaggauggaccaucuagagacugcaucauagagaugccagggauccaucccauaauuagccuccaaacgcugacaccauugcauacacuagcaagaguuugcugaaaggauccugauauagcugucucuugugagacuaggccggggccuagcaaacacauaaguggaugcucacagucagcuauuggauggaucauagggcccccaguggaggaacuagagaaaguauccaaggagcuaaagagaucugcaacccuguaggugcaacaacauuaugaacuaaccaguaccccggagcucuugacucuagcugcauaugaauuaaaagauggcuuaguaggccaucacuggaaagagaggcccauuggacauucaaacuuuauaugccccaguacaggggaacgccagggccaaaaagugggaauggguggguaggggagugagggggaggguaugggggauuuuugggauagcauuggaaauguaauugaggaaaauacguaauaaaaauaauguaaaaaaaaaagaaaugguguugacuuacaaagagccaagagaggagucaaauauggucaaaccacauuauuuugcaguucucaaagaaguaauaaaaaaaaucgaacacauuuccuaauauuguacaucaagcacuuacaaaaguaagaacaaaucauaugcccuaacaagaaacaauaauaaucagugugaaaauuagagagaagcuuaaaagcaauacauaaaauuaauaaaacacugggauaauccuuuuuaaaauuaaaauugacaaagauaaagaaagagaagauucagauuagcaaaauuauaaaugaaaaagggaaggccauuucaguuucuaacacaauuuaaagaagcauuagagaauauuuuaaaaagcuguacucugaaaccuggcuucuaauuuuagcagaaaccucacauagggucuccaaagccaacucugagccugguugguaaagcuuucuguccuugcuagucaguuucuuaucauuaagcaaucugggauucaaagacuuuagcagugaauauuuccacuucagugguugucuuagucacuguucuauugcugugaagagacaccaugaucaaggcaacucuuauaaaaggaagcuuuuaauugggggcuugcuuacaguuucagagucccuuaucaucauggcagggagccuagcagcaggcagacaggcaaggcacugaagugguagcugagagcuacauccugauuuacaagcuggagucagagggagaaaagaaagaggggaagggagcaagggagggagagagagagacagagagagacagagagacagagagagacagauauauauauauauauauauauauauauauauauauauauauauauauauagagagagagagagagagagagagagagagaaagagagagacagacagacagacagacagacagagaaugagaguuuugaaaccucaaaucucagccccagaucacaaauccuacaacaaggccacaccuccuaauccuucccaguagucuaccaacuggaaaccaagcuuacgaaccucugggaccauucucauuccaauccccacaaagggcuuccaccuuguuaauuuuacuaucaacgaaauugacuuuugacuuugacaauugauuuuguauacaaagaaacucuagaaaagaaagaaaacguuaagucauaccacuaaggaucaggaggcagcccuggacagccgccacagcagaaaggcuggcccuucuauguuucugugaaucauagcauaugcgcuuguaagaagugaaggauauuucuccauucaauuuuauacaugacaaaaaauauuccuaccaaaugugaaguggcaaguaugaauuuaguguuuaguucuccuuaaacagucaccagaccuugaggucuuccucagguuaccacagcuuguagcauucauuaagcagaauggaggaauuuuauuauaaaauguaacuaauguauuauauguuauuaucauuacaaacccuuguauguaacccagagagggaauacacacuauggaucugcuccaacuuuuuaauaaguaaauuuuaguuaaagucuauuuaaagcaaacuccuaagacauuaaccagcucccaagagcugacuacuacauguuauguuagcuuguccauggugcuauuuguuacucuuacaggauuucucuguguagcccuggcuguccuggaacucacucuguagaccaggcuggccucgaacucagaaauucgccugccucugcuuccuaagugcugggauuaaaggcgugcaucaccacgcccagcuacuauuuguuauucuuaaauagcuaaccacagcauaaaauuuuauuuuccuaaaauuuacauuuaaaagccauccaacuuaccaaagugauuucaaaccacaauuacauuuuaucucaacuaccagcauuuuauuuagccaggaucuacaugagacacauaucaugaugugcuauguacaucuuguuauacaguguuauauugauaacaaaugucaucaauauaacauugaauuaaucuuccauaauuuauggggaaaaaaggagcagccuuacugaagggcaaaguuauacaacagcuuuacagaagcugcaugcgagugcaguaccgggacacgggcacggacggcggcacuauaaccauuuuccguggugguaaucuugcuuucaucugacacagaaaagagaccgccguuuugaaaacucacagaacuagccucacgguuuugugaguccauugagcgcuggcugcgaagaacgguguuuaacucgagaaaucauugaacaaguuuuagaaaauaaagaugcuuaugacaauuucaaacuugaaggucuccaaagaaggacugagauauuggugagaggaguaaagagaauccuggugcauuuauuucaugcuuccuucuguucgaagaucauuuugagguuuauaaaagguggggugauccaaaaaucuccaggcugagaguccuggcugaggcugugaacugggcugcagagaaagggccacgccucccuccucugcucgcauuacucagcagcuuuucugcauguggcuggcugcagacaaucuaaacccuuccgcugucgcuccccccuuauacuguucugccaaaaggaaggcagagaggaaaucagcuacggggcaaagacugaauagugaacacauacagcaauguccagcgaguuaccuccugugucuuauuuauuuauuuauuuauuuauuuauuuauuuauuuauuuucucuaccgauucgcuaaaaucauaaagagaaugcuucugucugacaucuuggaccaaaaugcuucccauacugcacucuguaacuuuucaauugaauauuaauaacuaaauggauuuauaauccauuauuucccuuuggucaccuacucaucacggacuaaacgaaagggcaaugccauuaucuuccuggcccaacucuuaacauacgugucauugccaaaucaaaggaaaccuuaccacugagcaauucacagaacuucgcuuagcuaauaugcuuaaggaaucugagaauguccuacuaaauuuuaauugaaugaagaccuuuuagaagaauuucuucuguagauaaauaaaccuagagcuaagaaaggaaagcuacaucuacaggcuccaucucaaagcuaucuauaucuguagucaguuuucaggguuccuacauagagaauaaguauguguugaaaaaauacuacacuaguaagcagccuuuacaucagugguucucacccuguagguggaaauccuuuugggauuagaaugacaguuuuacagaggucaccuaagacuaugaaaaacauagauacuuacacuaugauucauaauaguagcaaaauuacaauuauuaaguagcaauagaaagaauuuuagaguugggagucaucgccacaugaggaacugugcuaagggguugcagcauuuggcaggcugagaaccacugcuuuauacuaccaaaauuuuggaagaaagggagugaguucauucauggccaaguacaauugcuaaagauggagccaagauuaaacugaucuaagcaagagaaggaaguauuucugucuuggagucuuagcuucucagucauggacauuccuugaugguaucuuuccacuuagaauauuuaggguucugaacccuauuucugaaugcgauuucuugacuuuucuuggcuucaauuccaucacuucugaagucuauaaauacuagagcccuauauagcccucuacuccuuuaaaauacuguccucaauggucgcuugcacacagaaaacucuacauaggccacgugacucuuagcuuaguuagcugagaaaaucaggaacucuuucugagcaacacuaaauugggcugagaaugagucagaaaagucaaggaaacaugaacucaaagucaucuagaguugaauucugggaagugaagcuuagagcaagcaaaggaccauaacaacaaaagagaggccuaaauaaauagauagauagguagauagguagauagauagauagauagauagauagauagauagauagauagauagauagauagauagauagauagauaaagcaaagcaauugucgagucaccaggauaaagaauagguucaucugcuuauguggccaaauucucaggggcacuucugccucugccuuagucguauuucggcucuuggcucucugauuguaugcccacuauuaaugcaccaauuacuuauauuaaguugaaauaagcucuuaauauaagucuucuguggcccaaacauaaugugaaaaucauuuucaugucacacuuuaauuacucauaauucuaucuuuguuucuuuuuauuugugagacacagucuugcucuguaaccuaacggccuguaauccacuuuauagucuaaccuggucuuuuaucacccugccucauuuuccuggugcugggauuacaggcaugagucacaaagcuggguagauucuucagggguuuuuuuuuuuuucuuuguauuuuuuaauuuauuuucuggcaaucucacucguguccauuauguguguugaucauuuuuuaucauccuguucgcccacacccaaugaacuucuuauuccuaauacauucuuuccuaguuucaugucucuuuguuggaaggucacagacugaguguaauuaaagcuguuuccaugaacacggcauuuuguggaggaugguuacuggagcauggacaacugacaaguggcuucagcauugaaugaaauaccugcuuuaccacaguggcacuuaagugcaugcugauggcccccuugggugaggguggaccuccuaccauaugucauuaaauaucaugggcuccaucuuguguaacuaaccauagccauugugacuuggcuauagcagagucauauccaggaaacaagguuuucagaacuccuuuuauguuauuucuuuccuaggagucguugcucauagaggccccaguggcaggcccauaaaacaguaggagcuauagccaucgccuuugcuugcucauuagaaguggaugauaggacccuguugcugaagagauugcagucuucgguuacagaaaauagagaaaucgaggcgggacugaccuagaagcuuccucccuuuugcuuagcauuuauagucccagaaagugcuuuuguaagcugcuagugaagaaagugaucaauggccuaaaucacuugugaccaaccuaccaggacaauguaccuacuggugcaauaaucacagggcugauuauuaugaggguaaccaacuggucuuugauuguaucugaagccugcuucacaagauggauucaugccuaucacuguuaagacugguccuaagccuauggccagggaauucauagguacuaaugagggaguuagaacuguugcuuugcuaaaugccaugcugucaaauuacuucccaaauacguuuguuuaugcccauagauagugcugcucucaaccucggcuagagaaucuucaucuuguaaugggcaaagguuaauauggucacucauaaauaaccauuucuuuuagaguaaaugacuuugagugcucaccccuaaaugaaucaucucuaccacuuucugaguggcucauggaacaugguagaaggauuucuauguuuuuacuauagagaauaauaaaaaaguucaacaaaaugaaauauuauaaauacuugagugauuugcccuaugguauaauaauuuuucaauacuuguuuuaagucuggaaagugcucuucuacugauuuaaauuacuguuuuaaguacugaaacuaaauaauggcacauacauauggaugacauguggaaacaauuugcauacugaguaaaaauauuaauaaaauaacauaaaguggaaaaucacucaucuuuuaaaacuggggauauugcuaaauauagauuguguguuuaggaagcccagagcugugggccugauccuuagagccacauuauaaauaaaguuaaaguaaaaaaacaaaaccuagacauucaguagggagauguuuuaaaaccuuggugaccuuguagguaucuuucaaaaauuguaucaucccaauuauucauauuaagaauauuuuuuaaagugccacagguaaaaaaucuuuucuuaaaaaaagccuuuaacauaaucucuagaauuuggaucaacaacauugcugagauauuaaaguuucaugguacaaauuaugacagaaaaguuugaccaaaaauaaagcagccauuguugcuacaguuuaaguguaagaauacaauagaaugggucuuggagagugacugaauuuuacaguuuuauaaucuuuucuaaugaaguacacaccuuguaaucauucaauaauuugaacaguucauaauauuguuuaaccaauuuagacugcaaagaccucggucugacagagcaagucuugaccugcuuaacauuauguuaugcuagucauuuuaaaaugagucuuuauuucccauagaaggucaguuuuuuuacauuauuauauaaucuuuugacagaauaacaaauaacauucugaaugucucauuucuaaauacaaaacaucuuaguauaaaauuaugcauuguuuuaaaugcuuggaaguagguccacauguagaaaacaaaguacguaugauaaaaaauaucaaaauuguauauucagcaggcauauuauuagaaauuguaccacccggugauuuauuaguuacuaggaaaacuguagagcuaaaccaaaaaguaaucauuaaauaacaaucaaugagucaaccaauuguuaaagaaccaaaucuauaggcacauauauauuacaaggcaugggguaaacagagauuugcagugugcucuccuucaguuaugaacuguacugcauaggcugagggaucaaucuauggcaugccaugccucuucacuuuccccaucagcuguaaggaagcacaaaggcgaauccgggccagcaaagaauaaugcuugagcauuugacauuucaccacuuccuguagcuugcaugcguuuuauuacacucuuugacacaauauuugauuuuacaaguuggaucaaguuguuuagucagcaaaacaggaauaagcaaaugagauucuaccugccuacaauuuccguucaucuccagccgucugucuguccaccggaaugaaaacuggagcauacucacaucacaaggggcacaugcaucagcgugaaugaagcuaccauaccucccuuugguuuccucaucuccaaaauggaaucuccuuuucaguauuuuaucuuuacugauuuaucauaagagcuguaugauucuuaccuuuuuuguuuacuuagcagagacaucagaauaguagaaggaagaugaacaaugagauaaugcugauuuuguauacaaaguacaacucuuaguaaaaaauguuguugcuuucagugguauaacaauguuauuaaaguuuuuaauccaugucuggcuuuuuuguuguuguuuacuuuuaucugucuggggagucuugcuaugugacagacuuguuuagaucugacuauguguccagucuggcacugaacugaacagugauucccuugguccucuuaccucgaacccuaaguagucagaguuuacauuugaggcaccauaccaggauuugcguuugacuucauacacauaacuuuaacauuuuaagauggggaaaugcaacaaaauauguucuuuucauaagaagagaguuuauagcucuccuauuccugucauuaaauggaaauaauguuuuguugaugauuuauuaagcaaacacgauugaugguuccuucaaguuugugacuggcgucucaacuguguuauuauuuguaguaguucuugaauuaaaguguaucagucuacggaugacauuccaaucuucccuaccucgauggaccaguuuauaaauuugaaggcugaucuguuucauguuccuacuuuucccugaaaguauucauaccuuuuuacgacauaccacuuacgcauuugcuuuucauuucaacauucugacuaaugguacuuauuaaacagcuacagucugguucaauuccugaagauguuaguacaucgccccuggaucucauagaguuguuacuaaccaaguagaaccucacagauacgccugggacaguccuaacacagagaccaauaguuauagaaaaucaaacucagguuugucacgagggcucuaagaaucuuuauuguacccuccagcuuugguucauugcuaauacaugcuuuauaggcaaccauaacucccuaaagaaacauacauagagugguauccaauaaaauuaaaguuuuucaaagagguccuuuccucaccaaagccuguggacagccagugugcauggcuaccaucagucgccacugaugauuccccuugucucauggagcauucuccccugguuucugaugaaaaaguugcgaaugggugagagaccaugccucuuaaaagcauagguagauauaugauagcugaucaauagauaaguagaugauauauugauagacaacagccuuccuaaaguguggcuaagcacuauuuauuacuucugucuugguccacauguuuauuuacuuuaucucacaaggaaaugaaauugauccgacaccaccuccacucacaaguuauccuggcuuuuacucugugcuguucuggaugacugucaauguaaauacaugagguuuguguugauuuuguuuuguuuuuguuuuuuuuuuucuuuagaagaaauuuuaagauauuggaugaagaugaaagucguaaggcuauuuaaccucuuuucucaaggagaauauuccaaauuuuccuuuuccuagaguuagauauuaacuuuuaaaaauuccauuaaccauuuagauauaaaucucaacaucuuacauucauuuuauauauuuuuaaaaaucggcaaaugaaugacaauuacauuuugcuuguauuuuaaaauucuucugucuacuuuuggccuagaagaaaaugccagcuuuuagaaaucuuuuguaucacauccauuaaucccuguuaacuugcucccucuaaauacuaguguuuguaaaccuuuucagguaucuccagauagcuggucuaaacaggaaucguuuaaaaccuuucauauguaagauuaucauauuauccucaauuggaaauacagacuguaaaaacuauuuaagauauacaaagcccuuacauucaguucuugauuuuaaguagucuuuuagaguaccaguagauuagaaaauacuuauugcuaaugaagugcucuguagaaauauuuguguucaauucacauuauuuacauugcuuuucucucaacuguuuuuuauuauaauuuaugaugugaaugauaguguauucacauguacauauauguuuauuagggguaggguagaguuaccaucaagguagagaauaacaucuuuucaguuagugauuuaguacuuguaaaacuucguauucaauaaaacugcauuaaucacuaucauuauuagucuauaagcuuauuuauauauuuuacucuugaaaccauuuacuagcaaacuacuuuuccauuauacauuuuaagaaguugacauuuuagcagugcuaucauuuuuuuacucauaaaauaaaaagcaggauguaauaaugucaaaaauuggaaugacuguaugccuaaaugucacucagcauggauaaccauuaaauugacacacccaucuaccuaagaaaguauugaggugauuaaaccaauaacaugaaaauauugacacuuuaaauguagaacauacggaaaaaugauguuacugagucaaugcauauuuauaaugaaggauuucacuuaagacugaagaguugcauuacacucugcaauauauuuguugauuuaaagauaaauuauuaagauuaaauauaacaauuuauguaauuccaaauauuuuaucauucauaguaaaagauacuuuuuaguauccagaagccauugaauuguagagacauguuuuguuuguuaaguccgagcaaaauuauuugauaacguaccauuuuaaauauauauugugcccauagaaauuaggcacugagaaaguaauacucaacgaaugaaauuucagugauuuuuuuuuuuagagcuaucuauuuuguaggccaugcagggcuuguauacauggccugguuuaauaauauuaaaaaaaugaagcaguuugaagaacugcuuaccauguuggguugggauacguaagagucuaugugagugugugagugagcguauguguguguguguguauguaugugaaacacacaacuucugcuuugaagaaagacacggucuauuaggagagacacacuggacauuauuugcgaugguugauuuuaaugucaacuugccacaaauucacauccucugagugggaagcaccaacugaagaaugguccuggucaccuuaauugauguggggaaacccaccccggguguggguagcagauucugguagccaucuagauaaagagagacuuaguggaaggaagcuuauucacagcuugcugaccuuuccucuugcuguugaguuuacugaccaucugguuucugcagcugacuccuuuauugaugaucaggaccagugguacccaaauaccuagcuuccaccaucgacuaaggucuagguaccuuccagauaccuuccauguuuuggccacuauauggagacugcugaggcacccagccuuguggauggagcaacuacugcauugccagccuucccagugugagacagccacuguggaaguaaugugauugcuaaaguagccuuaagaaccaagcaauaacagguucugaggcucucuggugugagcuaguuguuauuucuauuuuaauauaaacuguauaaacugaguaaauuauacacacacacacacacacacacacacaggcuuuugaaacacagaaauacagaugaggaugugauuaaugauuaauuccuccaggacacugggagaggaaaauguugcuaagaagcuuccucgguaggcuugaacucaagggcaagacaguauacuaggaagcaaaggaaagggcuguggguauaggaggcauguaaaauuaauauaauguuuugauauuuaggagaaaauugcaaaacaaaaugaugacaguguuugaaaguguuugaucagugccaagcaucacuuuauguacuuggcaaacaugacuugaggccuuaagcugugauuugcaaauguagauuggaaucaagaucuuuauagaugaggaagcaaaaaucagaagacaaaauaacauuaucaacuugaucucaugugcagccagggcugaacugcaaaugcugauuugccccagucugggcuccucaaaucguuccuuggaauccuauuaguuggaacuuuaucucugcucguggcagggugccugggaccauguuuauaaauaucugcugaaugaagaauaagugagucaaucgaaccagaacucacuuugguuaguuaauuucauucgugguauuuauggagagcagaagaaagaauuccagagacacgauuugucaaaacucucuaaagaaaaugaugacacuauauauugaugaaaaugaauguucuuguucuugcuuuauuugauuuucuuguccccccacuccccaucugcuagggucucauuacagcauaguucuugaauaucccagguugaccugaaguuacaauauauucuugauuuagauggcagacauugggaauauuuugacucuuaaaauuuaauagcuaaucuuugaagaaaauuaaaauagugaucuccauuuuguagacaagaaagacaaggaagagagaauuuuacaaagagauagcgaacaccauauaacgucauagcauaaucuaguuugggaagaacggagggcccugaagcaccaugguguuugccaguaaucacuguauuggaugugucaugcugaaaugcaauacaauuaggcuggcauaaaagcuaacuucacaugaagaaauagagacuuugagaaaucucuucugaagaagcuugucuauguguagaaggaugagacguuauugagcccagugggaggcuuuaucaggaagggguagaugucuuauauacuggagaaaaaaaaugcuguaaaacuaaucaaaauccuggaauagagaguggacaugaagacugggguacagggagcccaugaggaagaaggagcugcuucaaaacucaaagacaugguguucuaccuuccuacaacgugucuucaucuguaaaucaggguuuaaauuugauaaggcagaaaacagucacaagacuauggucugcguccauccaaucagcuuuaagguucaauucagcccuauaucuuuucuauaucugaucauuucccuucaagguauucccacuuaaaagcagaguaggguacauauuaucaauggauuuaugauucuuggucaacaguucaacagagguuucuuucuuuaucucuuuguucuuuuguuuuuuucuuuguuucuuucugucuuugucugucugucuucucuuccuccuucccucuuuuccuuccuuccuuccuuccuuccuuccuuccuuccuuccuuccuuccuuccuuccuuccuuccccccuucccuucccccuucccuuccccuucccuucccccuucccuucccccuucccuucccccuucccuucccccuucccuucccccuucccuucccuucccccuucccccuuccuccuucccuucccuucccuucccuucccuucccuucccuucccuucccuucccuucccuucccuucccuucccuucccucccuccuuccuuccuucuuucuuucucauuaagguuugaaauaaauuggccacuuagucuugccucuguagauaaggaagcacagugcugcuugugugcagguaaacaauaacaccagcacccugaaaaaguauuucccaaggaauaaaaacaacuccaaagacuuuaucugugggagaguaauucugauagaaaauuagauaauuucucagcuuaugugugauguuuuaaaagaccucaaguuaaguccuaagagaaacaguuuuuaucuuaugcccaacucacauggaaaugcccuuagcaaugguauuuauaguauccaaaauguacaauucacaaauguaucaucaauagauggugacgguuaaacaagaugacacuuagacuagagaaugaguggaaaauaauguaugugacacaaguuggauaaaucucaaaaacauuuuagguagaauaauggauuauacaauaggacauaaugaauaguucuguuaugaaaugucuagagacagcaaauguucaggggcagaagguaaaaauccagauugccuuggauugaauggaagucgauauuugguauuuuugauacuugauguacauguuuuaaaaugauugcaaugauguuuuuacaacucuaauuguauuuaaaagcacugaacuacaaaaagauaauaaaaugauucuuacauaucuucaaaauuucauucauuucucuuuuuaugaauuuaauuauauuauuacugguguguguguauauguguguguguguguguuacacauaugugugaacuauggugcacucaugccaugauguauguuuguaaaaggcagaggacaacuuucagagauggccucucagauccuugcaguauagguuccauugacuucacucaagguguuaggauugcauagcagugguugcucagccauccuucugguauucuuucuuguuuuagaauuguaaugucuuaauuauuuuucuacucaguuacauuaguuaacagcaaauaagagaaugaaugaugaggaaauuauuuauuacuaugccaaacuuccuguuucacuuggagccccaauauuaugaauacuauuacaguggccuaaagaguguuauugguucagugucuuaacugauuuguuaaaaugacuacuuuaaaugugaaucauagauauaaugcuaaauauaauuuuagaagaggccucuauaauaugacauauaagacagucaacuguucuuuugacuaggaguccucaacuucaaaucgcacaagcuaagaaagugcagaagaugaggauuccagugagcugacggggugguucaauacuuuuuccaaggauuuacacucugugguuccaucagcaccaauguuagcugaccaggauggcugcggcucaagagugugacaucuagagaggcugcagcaguaauaaggaagaccuuuauuuccccuuguggcguuugcccaggugagaaguguucuuccagaagccugacugcagauugcccucauauuucauuaaugaggucaggagcccaacacuuauucaaucccuggcaagagcaaugaacucgcaaacaagcccuccccuggaauuuuuaugaaauuaaccaauuuccuaggucuucuggauauauaacccagaggggagagccauacagaauuacaguccuacuuuagacagaugcuaucuauucuauuacuaauguaggaaagaaaggcaaggucacuuaaaugucccugaacucaccacuaaucaaggucauacagaugaacuugaacauagcauuauuuuuuaaaagccaugaaauuuaagauuaucucuaacuuagaguuacauauuauaauuauauuuaauaaaauauauaucauugacgguggauauaaaggacuaccguuucauuuaaacuaauaauuauaguaauuuuuaauauuacagaguugccagcucuaaaugggauguguccuuggagcucagagaacccuuuggaagaggagguagaaaggguguaagagucaggaauggagaucagcaggagaacacagcucugugaaucaacucagcaaagcucauacaaacucauagagacugaagcagcaagcacagggugugcauggguguauaccagguccucuguguguauauauauguguguguguguauuauauauauguguauauaugauauauauguguguguaauauauacuauauauacacauauauaucacagcuuucaguuuaguauuucuaugggacuccugcgugugaaugaguggaccucugauucuuaaaccuacucuuguggcuuuuuaucuucuguuuguuugccuuguccaguuuugacgugaugauuuuuauuucaucauauuguauguuuuauuuuguuaugccuuagaagccuguucuuuucuaaugacaggcagaaacggaauggauccagauugaaguggagaggaacugggaugcggaaagaaagaaucuguuuauaauaaaagagaaaauacuacguuagucugcuuuaauauacaaugugguucuuagaucgcaagaaaaauauuaauggcacuuuugccuuaggggagagcaaacuuucaacaauacauauuugaagaauaaauaacaauuugggaaacgcuuuacuaucccucuucugaaucuaauauuaugcaauauguuaugaaagagaaauucuaauggauauuuuaaaucccuuaaaaauguucagcugaagaguccaguguuaguugcugcuagaaaaaaaguuaaaaacaugagaaaucaauuagacacuguaauucuacagguuauuacugaugauguaaaaaucauuuugucucucuucuugaaaguugaaaaggugaaguaguuuaaugaacuauaacauauguuuuggauaaaugguggcagagugaaagaaagugucaggcaaguccuaugugugcuuuucagccaaggagaaccaagcacaagagagggguggagaauggucuuaaccccagucuacgcccaagcccuucucguuuuaucuuguagaugcuaaaaagauguuguuggaguuccguugucucagcaaaagcacagauuuggaguuguauuucauauuucuuuaaaaaauauuuaugaauguaguguucugccugaauguauaccugcaggccagaaggcacaucagaucucauuauagacaguugugagccaccaugugguugcugggaauugagggaauugaacuccugaucucuggaagagcagucacugcuuuuaaucaccaagccuucuauccagcccauguuugauauuuuuaaaguaauugacauuuuaaacuuucucucaaaagucaugaucugacaaauuuuccaugacgauaggagugauuuuauaaauuuaaaacuauuaguaaaaauguuuuaacauuauauuauuuuuucugauggcacuaaaaauauuugaauauauggcacauggcauauauugaaaacaucauaaaauccuauuacacaaaaggaauaauguagaguaaaauacuaaauauuaagcaauacccaugauuaauauggagaauaagaaauuaugagaucaugaauauuauuuucuucuuuaugcauuuacaaaugcucuguuuuuauaauagcauuauaaguaguaaauuuauaacuaugaaaauaauuggguuauuaagaguuggcuccaagccaacaucaauggaugucugaaaaauguaaaagaagaaauuaaaauuuugagauagugaauuaagucauaagagcugcagauugucacuugagaaaaaugucagaauaaauuagaagaaagauauacugaugggaguguaucugagugauauaaucagaaucugugugaaauaauauaaaauuauuauaugcuuuucagguauauuuuauauaaugguauuuauaaaacauccuuaaauuauagauuuaguaaauauguaagaauaauguaaaacuucuuauuuugguuucauuuaacuuacuucuguugggcaauuacugaacauacaaaguugaaacagacaguggugacaguaccuugucacacacaagauacuaacuacaucacacugcaaagaagguauggagggaaagacaagcagacaccacacagugcauacaguuggugcugugauggaaguccacacugggccuaggcacaucucagaaggaaagugacuccuacugaggggaaggagaggucaugaugucacagagaaugaacaaguuucgaaggcuuggaagcagcuucaauaacucacagacacauuuacuucuacaggauagauaggccacaggguaagagguaaaccuagacagcucauggaagccagucaucuugcauuggauuuuuaaacccugacgccacauuuaaauaauggaagauuuuuguugcuguugcuguuguugccauuggugguguuugcuuugagauagcauaucacuuuuuagcccaggauggccucaaaauucauagugaucuucuugcugaagguguucuagcaggcucuggcauggcaaacaguacacacagguuugcacuuucacaucuuuucuucucccuuuccccaaggucuauucccucauuuggcuacugauucauuccugagaugaaacaccgagggccaacuauaagaauuaauuauuuggcuaauauguccagucaggauuuacuaauucacuccagcacauauuucccccuuuccccuuuaaaagcucaaucaugaagaagcauccccuugcuucuuuugccccuugcucucugauuucuuuugcuuucuuacuugcugcuauguugccuuagcagcagcuugaccaucucccuucccccgcagccccacauugcccccaccugcuccuccuaguuaauaauucgguguacugagaauuugguuuaagagugccgaccucccuuucagugaugcuaugacuuggaucaggacucguuucuaggacccccgauccaguucuccuaauggccauucauuucaucucacagcagcuuauuggugagguuucucuuacuacccauccuaaaccuuccccgaaucaucggaugauuacuguugaaugucuagcaucccugcucugucuugcgcagguggggagaaugcaucuccccacauaccccagccuucaguggccaagguggacuuccuuggauggucuucaggcacaucccauuucauucagcuugguuuggauggcaguugucuuuuucacuuuugguugcuauccguuucuaaccaucugaaaauucuaucgacaagcuccagauuucuccucaguccacugugccuuccccuuggugauggagcuugggugacgaccccuccucacugaggcucuuaugagccaggagauaucuucagcucuccacucuggcucaaggccaccacuagcaaaggaaacugacucucucuguacugacugaaaacuccagcacacaccuaaaguuacugaugcaucccaccacucaaagaacggcccuucuauucccuauaagaauaaacaaaaugacaauauuuacagaguuggaguauuccaggcaugucccaucacacuaggcucgacagccuaaguaaaaugugcauguuagcgcugaugggaacauagaggucagcugcucacugagaaacaggagaaaggagaugaguuagaucaauagaaaaugcuuacauucauuccaguaaggaaugauaaaaguuuaaaugaacauucacaauuugcugacuuacuucacaacacguuuacuaaagcuuagcaaagugauaauaugcacagauccuuuuauuguagcaggaaacuuuaaaacuaauauaaugcgauaaauauuuuauccguguagcauaaauuaaagggacucaauugccugcaucuuaaucucgauuagugccuguuaauagcaaaacacacacaauuaauuguacuuuaaaagcagaucaguuaucaaacucagccuuagaauaaaaauuuugaucuucaaauuuguuuauguaguuaauaucauuauuguuaguuuuggugccagggauauaacccagggguacacaguaugugcuaagcaauggcuuagccccuagcauguacauuuuuacuaugguugaggaaccauuaaagcuuuagcaucaaugaauuaaaugcauugcuauuagaaauuagagaaaucuuaaagcauuaaauaucaaaauugugugaacaucaaucauaaacaaaugcuaacuaaguuacuuuuuaauggaaaaugaccauguuucuagagaaaaggacuuacguggcauggguuuuuauaauuuuauaaauuuucaaauaucuaaccuaauaucuagauucuuuuacauuuaacagauuuuaauuuauauuuagauggagaauaugaaaaacaguuggucuugcagaaagguguguggaaaccugaaauagcgauuucauguaaguauaaauauuucuccuuccugguaggccacauuagauaaauaggucagagucauauccgcaaacccacuguacucugaccuaugcaauucauuggcuuauugugcacaguuaggugauuuacuauccacaaagauauaugucauaagcauggcccauuuauagauuguuagcugacugugcuauauaaaguuuaaauuuuuacagccucuccucauuagucugucaacaucacugcuagucacaucuggaaauccuucauauuuaaaaugcugcucaauuccugguggcagaaaaguguuccaguauucuaauggucauuuuugucacgggcaauacauauuuacaauuacuuuuuacuccuugacauggcucgaucacuucucucauuuuugaaaaugacuuaaaauguaagcuggaauggucugcaccugucuaccugcuacauuuuccaaggcgugauaguguucaauggaaauggaaucaguccagcugguaacucacacagcugugcagguguguuuuggggaugauauuggggcaccaaacaaacaaaaaaacgaacaaacaagaugagcccuggggcuccagaugaaauaguuuugcagcaucaucaaacagacuccuuuaagggaauuggauuuucauuuuauagauuauuauuuuuccuaggagcaaauggcugugaaaaauuuaacaauucuucauaccacugccuuacuaaggauuaacauugagaaauauaaauuguuuuuguaaauauaaauaaccaucaacagugaaaggaaggaagagugcuuuuauaugacuauaaagacaguugggauaugauggaugccuaaacguuuucaaggaaaugcaccaaaguuaugggguaagauaaaaaauaacugcaaaaguuauuuuuaagacuguucuagucuugaugggguggacacauuuuugagagcaucaaagacuaaacacugaguugauaacaugacugaauguuuuuuguuuuuuguuuuuuguuuuuguuuuuguuuuaaauaaaugucacaauauggcgacaagauuaaaagugaagaguaugcgagaguagagagucaacaaagucauagugacaaaggagagguggcuaauuggugagcagguaagguuucucucuggaggagaagcugcuggaguuugucacuuuguuacucuacaguguugccuggaguucgauacuucauuacucuauaguggggugaagaaguucaccuucuuauuuucauuuccuucccucaaugauuucuucagagcuagcucuuaccagcuagaaauucuucaaacgacacucgugccuuccuucacacagguugaacuauuugucucuaaugcccuaaaguacugguguucaaucuuccaggcacuuccaaugaucugaaaucugaccugcuuaggucagcuggcucugagauuaugguauucuaguccucaaaccaaccuguuggcucguugguuuuguaccaaacacacugacuuacauagcucaaaauaccacuggccuuuuaaaaauggcauaucacauuccaggggaggaucaaaacugcuggcuggugauauuugucaagucucucaaaguugcacuuuccaggauuuucaauucacugaauucuuagacagacauguuuaugugaaagaauucuuuauauauuuuuucuccucuuugagugggcaaaugaaaaucuugaccucuggguuccuuauuuuauuugacucucuguaguauuuaaaucuuaaaauuuuccuuaaaauaaucuaaguauggauauuaauccaugauauuaacgaucgauccuuguuuacagggugccuuucccugcuccuaccaggcgauuucauauuuucaaggaucaguucuugaaagaggauguagcccucgcucugccaauggcucuggcucagccucaugcaucugccuuugcuauagucucaccggaacauugacauagauugauuuugccaaugugaucaguugaguucuacacaguuuaaaaaugucauguucuggcuuaguguuuagugguguucuuuguucauuuaucguuuacuaucuuuaguuuuuuuaguguauacucauuuuuuccccuacuaaaacccauagccaauaauagacauuccauaaguacaaguaaauuuccugaaaauuuucugaagucugacuggagacauuagguuacaaaauuacacaauuucaaguuucuuauaucaaaucuaaucuuguaucacauuucuuuccaaaauuuccauuuuuacaauuuugcuaaaacagcaaauuaauauauuaaauauggacuaauuuaauuaauauucuaggugauaaaauauuaaaauauuuggcuauuuucucauuuaucuccuggucacuauuuugauuauguaaugcuuauccuuauaaauugauuugccaaguuccauuugauaaauaauguguucuaacaucuauauuuaauuuuuuaauguuaaggauuaaguuuggggucucacacauacuggacaagugcucuaccauugaaccuauuuuaacuuuuaaaacaguguguucuuauuucaaaaauauuuucugccauuacaaacuaaagaauuuagaaacaaaucaauaaaaugggaaaaacugcacaacuaaauuguuaguacuaaugcuuauugugcaauguuuuaaaguuauguuauuuccuuaugguuuuuauuuuagaucuacauaaugaacauucucuacuuuauuaaaaggagaaaaauaauucugacuuuaaacaaauuauaacaagaaaauagaaauuauaauugcauauagcagacucuaccaauucuaacacuaguuuuauucauuuuuuuuuuaggggaaacaaacauuuguaucuuuuugggauuugugcuauuguauccucagcaacuuuguacagaauuaaauguuauuugauauguuacauucaauggcccuguaauaucuuuuuguuuacauagauuaugauuuaacauaguauauguaaacuguuuuaaguuucaucggguugcaauguuuuuuccuacauaggaaucuuuugguagaagugacaguugaagguccagauuauuauuaauuaaaaugauuggauggauaguccaaacuuaucagccagacgcugauuuguuagaacuguaauuccaaaucuguaccacaaacagcaagagagaacaguuagcugguuuguuuuaggagauuacagcaucggaaguccaaccuugggccaacuacuuuuacugcuugcuucauuccugccauuuucuggugcaaauguugggcucuaggcugcaacauuuucccaagacauugcacuuuguuuaaaugagccugacccaguuucuauugcuuauagaaacacuuuggaauugaucguuuuauuuauaaaauuguccauaagcuccuaaguuuugcauccaucuugguuccucuuguaauuaaaaugaguaaaagccuuaaugcuuagcacagaugguggcucuaaauaugcauucacuucuccacaucauguuauuuaugcugcuucuuuaaauauaaugguaauuagcuaauuacaacauuagcauaucaacauaugcccacacuacuccuuauugugggagaaggguauggaugacgaaaauccauccuuaauacaauuuuaaucaugucaucagcaacaaaaaaagacugaauugauauucagucuuccuuguguauuuuagucaucauaagcaagccaaaggcaaccaucacaagaugaaucguguucaccucuagguucauuugccuaaagccaaacuucccuacuccauaucuguguguauuuggaggcaaggccuuuaaaauaguuggaucacacgguuagacacaaucuaacuuuucuccaucuaaguggaaauuuaggcaucaaagcaagcacugugaauucaggaucacagaagaaacaaacaugucagagcacagagcaugaaaccagcaagccaagcagagaagcaucacaaggaaccauaccugucaauaucucaaagccugaucucaugcaaacuauauuccuauaguuuaaaccacccagcauucaguguaguguuacauaggcccaaagcaucuaaaauaaaaccaacucuauuugagaaguauaauuacaaguacaacagaaccccuaauggcauuugagagacaaaggugacuaagcagcgucuaaugaagggcaugagcaucacuuacaugugugcagcagaggacgugcaaugcaggagggacccuucugggaaauaacuagccaucuccucucaggaagauuagguucauuaaaaugcuguaccuaauuaucacuuuugcuuucugggaguaucauaaacaaaugcuuucccaaggagaaggaaaaauuuaugguacacuugaacccaaagguugcaaugggagaauaugggucauuuaaaaaaacccaacagauuuaaaucuauguaagguuuuccaagaagguacuuuuuugguggcauuuccuuuaaaaggugucuuguauaucuaguguaaaauaaaugauaguaauagcacaaaugaaucaccggccguguugcuaagaaaguucaacuuggauagagaaugcagucuuuucaagaaagaguucuggacuaaguagaugcuuacaagucaaagcaaggagcaugagccauaagccgaauugcauacaagaaacugacucaaaugaaccagagacauaaacaaaagagccagcuacaaaaacauacugcaaacaaaacagaaucaauguccaguuuugcauagaguuaggccuauaugguacuaaagaaggacaggugauauuaaaaaaaaacaacaacaaaaaacagaaacaaacaaacaaacagaaaguccguagauacugcauuaaagcuagaggccuguuaucaugggaguaccagaggagcugaacaagaguuuuuuuuauugcucauaggagaaaacuugaaaccaggaucuauuguaaguugaaauccacaucucuuagaaaauucuagggucugaucugagaacaaggagaaaacagguaguugugaagucuaaaaugauucuuauuuacguuauacucccuuauaauguggauucugaguaaacaaagcaguaauuucaagcugagcucugguuuuccaauagcacacucauuuacuugcaaaacaugacuugauugaacaccacuggccagcuguugugugccaacugcaggggcagauaagcuccggucuacauguuucuucuuguauguauagucuguaucauucucaccaauaaccucacccagaaucuuucaucaaauugugcauaugugugugcaccuguguugggugcaugagugugugugugugcauguguguguguguguaugugcaugugguaugcaugagucuguaugugugugcaugugugcaccugugugagugcacaaguaugugcacauguauggguaugucuguaugugcauguguaugugugugcaugugugugugugugugugugugugaguguguguguauaugugugugugcguuguaacauuuuucuagccaacaucacugcauucuaggaaugacagcauuuuuccucagagacuuaacaaguuguuaaaaaaaaaaaagcuccuuguaaauaugaacagauuacuuuucuaaaccuagaaacuugccaauauaaaauacaaggcuuaaauuuauucaaccaauuucccucaugcuuuuuaauagaaaccacuuuaagagucugaguccagccaccaggaacccacagauguggggaugggggugucuguuagucccagcucuuucuuaccucugcauagacccacccauacagaggguccuuuucucacaucaccucaggucccaggucccaggaccucugugcgguuucuguucccaguuuuucaaucauuguuccuuucuuauacgcaagggucuccaucccucuacucauuuagaugucucaacuacaaggucacauuucuaccuccuuuuucucuucaagccccucucuccuaucaucucuuuaugcgguguucuuuuucuuuaagggccuuugauaguccuuugugcauuuuuuucuaacuuuauuacuagacugaaggcaacauaugggcaugaauuuccuuguaauuuccaucuuucaacaccuucggacaccaacuagagggcuuuguaaaaaaaaaaauuuaacuuggaugucacuuuuugacaucuuggcaugaaaggauagagaggaguuaugcuggcaagggcugauuuccuuuucggagucagggcuaaccagugguucuaccaccacacagacaugaguguucuagaauacagaagcuauggcaaggcugccugaguucaaguuugugcucugccacuuaucuguguaacauuuggcaaggcaaucuagucucauagccuucauuucuucccuugucaaauuaucaauauuacauaguucuuacauuccugaaguacugcuuagcaaaguaaguacuaccucucuauaauaaguugaccucuagguacguagauaaaagagaagaguuacaagcacaaguggagccacuuuguagaucaucuggauuuuucagacacgugugcaccaagaguaagucucuuucuacagccuacccuaagccagagaaacacaaacggagcuguaaauuccgcuuaauugacauuucagaauuucaaagggaaguaauugcgucccugagcuucucugcacugauccagagugggacacaucucagcccauggauugcugugguucucuuucuuucccugcacucuuucucccccucccacucuuccaagucagaucaggccuucuugcugaaggggaauggaaaggaguaccuggcggauuucaucuucuucaccuaaccuggagggagaggacaacuuggauagaacuuggcaugccugguuuuacugccguggcccccgaggacuacccagaucuccgcuguccacagagaauggaaauuaaauucaggcuaacuuucaucaucaggaacacucagauaauguguucugaucaucaugugccugugugugugucaauuuugagcaacucuccacgagagaaggcuucucaguggaauggaguccugaguuucugguccuuggguuguguccuucugucuguccacuugcuccugaucuuuuuggaugggaaggcagauuguuugcucuucuccccagugccuucuuggauacuguauaauuaauuaggccuccaaucaugccuucccagccuccacggauggagaaacccucuccgccaugccuuaaagaggaauugcuguaauaaaugagucuccugauagcaaauuucucagcaagggggaaucgcguaaauggagacauaguauugacagcaaaguccaauguguuauuuuuaccagaacgaacucuccgguucaagccuuugaaagagacauuugaaaaccaaaaacaaacaauguaauggagcgaggaaaaaagccacagaagugaguggcagggaguuuaaaagagcagaugccacugccaggucuaugggacauaaccagccacuugugcugggucuuggcaguuuauaaugcuaccucaucuucuccgcgaaauuguuuucccguaaaucucuguggccauccauuccugucuacacauuauguuccuaaaauagacaccaucuaaaaaucacuucaaggagcuuuguggaggaaggccuaaauugcaacacuccuccagcgaagauagaugcaguguuugauggcauuaccagucgguagccaggaaggggaguuugugaggaguuuuuccaccacaguuaaucuguuucuggaaggaaagggaagugucagacuucccgaggaggcaaacguguguggaagcucucauuugcaucacccccggccugucagguauugcagcaaaagggagaggugagcuacccuggcucuccuugggcaggagggacagaaucaggaagcaucaaccucagcauggaauuuuccuauuccuguuuggcauccuccucuugggaugauuuacagcgcggguuggagaaacacgcucugccacuccacuagcgcaccagauagacagugcagaccugcagauccauacccgaggagaagccacauuuccuacgugugauagcaacagcguuuggcaauuugcgacuuugcuacugcagcuuagaaaauauuuagucacaugcacaucugaacagaaagacacccaggcuugacucagucauuuccgucagacacacgaaagaaaaagcgucucugcucacaagcuuauuuggacugcuuuguugaaaggaggggcggcagacacuuuguagauguggcaagagggcuuuauauccagaccucaaacagguaggagagaaggaagccaggagagguaaggaaggggcguggaaaagccucacagccaccucgaagaaaacaguuuuuuugcccuguucagaaagcaagagguuccacagugguuuugugucaauggagcacaucugcaguaucauugccguuggugaccucugucuaauuaaaaguaagucaguccuucccacccggcauugucugaaacccgggacucuuuaucacuuugcuaaaguucauuugcaaguguaguuaaggaagagucaggggggaaacagcaucugucccuucugguccuggggaggaggcacuccuuuccaagagucaagccucugcccaaagaagcugccuccccugcaaugcuaggauccaggagcagccccgcugccuucuugcuuccucugugaggucuaauuuuugcaucaucuuuaggagcgauaugaccucuauucacagccaucgaauccaguuccaaagcaccaaugacagagggggcuucaagacaagaccuugccuaggaggaugcaggcaagcaaaggcaagagcuggcccgaugccaaguuauuuuaggccaaagaaucucauccuucuaucaaaaugcugaacugcaaaacgaaccugauuucaguucauggaagguugagaggaggaggagggggaggggaggaggaggaagagaggaggaggggaggaggagggaggaggaggaggggaggaggagggggacaguugguccgaauucacaugcaaaaauagacuuccuguucugccccaacucuuauuuccgugggcucuucuccccaaggauuuaccagguaagaauucaccaccaaagaagaucacaaugagauaaucagauggcuuaccugauaaaaaggaaaauuauccaucugcagugaggagcaacaucuccccacgacgaguccgcaccuuccguugcaacgauucagauuccuucuugcaaaaggugaccaagugcuucacaagggcugcagccucauaggggcagaacacacguacacaaacacacgcacacacacacacacaugcaccagagaccucugcaguauccucucggcuucauccucgccucacucuaugguaccuaauacaaaucagcaaauagcuuguuuuaaaaaaaaaagaaagaaaaaaaagcggagacagcaccuaacguuacagugccaucuaguggcuacaucguaaauagguucucacagccuggauuucuguguucuuucucaaccgcuuccuucugguuccuuuuucuuuuuuccucuuuauuuugguuuuauuacuuccucagaugccuuuuuuucauuccccuuugcucugccuaucauggaacuauugacuuaaagauuaaaacaaucagaacuggagagcguugcuuuuaaguuaaaaaaaaaaaggugcuaauuuuguuuguaaauguuacuuuauuuucucuauuaaaaaaaaaaacucauuguuacuuuuacagauuacggaacccaugaaugaaauuugcuuauuucuacugucuggagaaaagugaguagucuuuuacuacguagucgugacuuuacaugaggaauuuuguggauucuuucuucucuaacaccguguucacggugcuuuucauacuauagugaguggcucugaaggaggcagaugcgaguuuaauuuuaaacucaguaucgaugaguguguuuugaagauuauaucccccuaucuuuaguauugauguuaaauaggauuauuuuuauacccauuuccaugguuucaccaucuuuuauuguaauauaucuauuugucucccagauaugacuagccauugaauugucacacuauguuuuagagaacaaacguaaguauuaaauauuauugguguccacuaggucuucccaaaacaaugaggagcccauacugaagucuggggagcuacaggaacugaacuuucuaagccauauauuauaauuuaaagcaucauuagucuuucacauuuggucauacauaaacuuauuuacccuggguguguuucucuugucacuuagcacacuuaaugcugaugaaagucaccauacaugcuuugcuauuaaaaaaaaaaaaaaaaccaauaucccuuagacuuuaauuugucuauuccauacuacaggacagggaggcauauacuguuaauauuccucuagcaauucucauuguauguugagaauaaugagacauucugaaccuuauugagacuuuucuagaccacauaguuugugaagcaaaacaaaccaaccaaccaacaaauaaauaauaagaauaaggauaaggcccacccuuucagaauucauuauuuuuuggaaaauaguaaauauuuuaccucuuuccauucuagaauccuggagauguaauuuucauuguuucuuuauaaagaaauuuuacaaguccuuguuuauggguucauggguccaucuccugggccccuuucuuaguuucugaaaggaagcaauugaccaaaauugagcuggaaguauauagcucauuugguagaacacuuaguagacaugcaccaaaaaaccaaaacaaaacaaaacaaaaaacaaaaaaacccaaaaccaaaaacaaacaaacacacacacacacacacacacacacacagauuuucagccuuguagacugcuuguacaauaaaaacuucagaacuuggaaugcugagguagacugaucacaaauaugaguucaaaguuauuaugggguuagaaauuccaugccaaccucagccucagacauagucacaggcucagccucagcaacuaccacagccauggucacagucagagccacagccacaaacacaaccacagucacaggcacagcuucagacacagacacagagagagccacagucagggccucagccacagcauuagccacaaccucagccacagccacagcuacagguagagccucaggcacagacagacacaaacacacaaagacgcagccauagcugucaaagucacaaucacagucucagccucagacacagacucagccacagcuucagacacagacauagucauaaacacagagaaagucacagucauggacacagcuacaaccacauccucagcuucagccacagccauagcuauagcuacagccucagacacagacacagacagacacagacagacacauacacagacacagccauagcuguggccucagaaacagacucagacacagccacaaccacugccacagccauugucacagccacugccacagccacugccacagccacugccacaaacacugcuauagccacagccacugcaauaggcacugccacagccacugcuauagccacagccacugcaauaggcacugccacagccauagccacugcuacagccacagccacugcuacagccacagccacugcuacagccacagccacugcuacagccacugccacagccacugcuacagccacugccacagccacugccacaaccacugcuauagccacagccacugcaauaggcacugccacagccacagccacugcuacagccacagccacuaccacagccacugccauagcugcagccacugcuauagccacugccacaaccacugccacagccacugcuacagccacugccacagccacagccacagccacugccacagccacugcuacagccacagccacugcuacagccacugccauagccacagccacugcuauaggcacugccacagccacagccacugcuacaggcacugccacagccacuuccacugccacagccacagucaaagucacaaacacagacauggccacagucugagcuucaguccgcacuacauaaugagaagcugucuucuuaaaaaauuaaguuaacuuccuguuccaucuccaaaaugcacaauaauuuguagcucuucacugucugaaaaaaguguugcuccuucucugguucaggcugaguaacacuggaagaagcuggagugaccaacacuugguaacuaguuacuagaaaguuugaaaugaaaaggcagaagggaacauuugaacuaagaaguaguuuuauauuuauauuaugauucuaagaccauauacuccauaugaacaguacuuaggauuuaaauauaugcacauaaaaauaagaacauccaaaagacauacuuuacuacuuacuaauagcauauuccagaagucaauguugugcauuuuuucuuaauaauaauaucaacaucucuccuuccuuauugccagagugcacuuggucccuugucuauagaggaccaggagggcgugggugguguguucccagcugaaccagucuaaagaacuaugacaugacugccaucuauggaacuaaccuucucuuuucucucaccauagcauuagaagcagguagggcaggcaggaugccuacaggaaaugucacagcuaaugaagaaugagggaaccauccaaagccagugcacucccuggguuccuaaugauaucacagguacaaggcagaaucucagaagaucuggaacgucccugauuugaguauacaagacagccccuaaaaagucucuggaccaaucucuuuugauauccccguguacucaaaaccaguugauuuauggagagaggaguuuaagcccugaagauaucaaauauugguuauaucauggguguccaacucugaauuuacucacuucaaaaguaccugcuaauaaaggcauuuucccaggcuuaauuaacaccauuaagccaagcaaaugaacucuuacuuugagaaguuuccaucucacaaugagagucagugagaaagggagaguauuuucaaugcaugcaccccucuuccuucgguuugccuguuucuuucaugacuucugcaucuuaacaaacauccagccaucugcacaaggcaaaguggaccagugucuaggucaaacaucuuuuucucuaaugcuuucccuguguuuucagugaauaggcuccuuuuguuaauuguaaaauaaauuuauguuuucuuuuauggaauauggucacggauuauauugaaaauguuaaucgugagagaauaaauguuucuuugcagacuguuucugaagaagguuaacauuccauucacuguacaagagugcuuuuuaaugaauaaaaaauauucauuaaauauagcuugucauuuaguagcagacacgugauucaucagagugguaacaacaccaacugcuuuaauuuuucuucaucuaagaccugccaugaaggaaaagacaagauuuuuaaaaauuagacccuuaaaacuauguauuuaaauuuuaaauguucacuuuuuaaacauaaaaauguaaacuaaaaagaaccguaaaacuuuaugcugcucucacccuuguguuugcuggccucucuggacuuuugcuaaaggucucccauuucuaucugucuaccuucuaauaaugaacugcaguugggcuggcauauuauaucccauauaccuuuugugguaucuuaguuaaugaagaaaaguuuuuauuuuucacuuuucccuggcuuauuuccaucaacaaagacugaaggggccauuuccuuauuucugggagaccccaugugaucucaucucagaaaagagaagaauguuauuucuuggcugucucuacuucccuagauggugggugcaggaacuugacagguaagcugugggcugugccucuucuguaagcgguuccaacaagagaagaaaaugagaacacaaaaugucuugucauugcuuuugccacucugucucugucaggaggacacagccaucucuuugccauuacucuguggggcaugggcucugcacagacaggauggucuccaguugagcugaggucugaaccccguuugugauaauucaccuaaauggcacgguaggcguucccucaugcuccuggaacucuggcuccugccuaaguuacugccccccacaacccccacaagagaagcauggucaguagucacguaggcaauggcccaagcuucugaccuucaagcuaaacuccuccccuguuaccuagcaauagugaggaccauaaaaagggcuguuuagccccugcuugcucucuuaccucuuacuucucacucucuuaccccucacucucacccccucucuccucucucuuugucuucucuucucuuuccuuucucuuugccuucuccucuccucuccucuccucuccucuccucuccucuccucuccucuccucuccucuccucuccucuccucucucccucuuacucucuuucucucuagccuucucucucucucccuucucucuuucucccugccuuucuauaauaaagcuuuaaaaccauagagagucucugcucaucaagauccgcuucaugcacucucacagguguugggaaccucuucccucgucccgcucuucuauaacccugguggcuuuagcaagguagcuccuggauccccagguagggcugccccuuggccacccgcugaagagugggucagaggcuugaaugcccacccagggaugaguggaaaguguauggcagcucucccaugccugacagaccagagaauagguaaaacucuggcggggugugagucccccccuucccuagggacccccuuuuuaguucccaacauuacuccaucacuugcuggaaagcauuagcugcuuaguggccaaagaagggagauuacaagagauguuaccucuguugguagaauguggguauuaaagaauaaaugugggauucaaguggaaaagauagccuagguucuuucuaccuaucaguuuuaagauaagcaagaggaucucuugugauuagcaucuugaaugauucaaauguucucaagaccagaaggcauuaaaauuccacagugaaauucguaaaaucuccuaacauggaaaaaauauccuuuguuaauuucaauuuuagaauguuaauugucaugcauugugacaaccacugcuugaauauauuuuuugauaaucauuaaggaauuguggaacuggaaaguuuucucagaccauccagaagacgauuauuauuuuggauaacagaaaugugacauccagagagauaguaugucuuguucaaggcuauacagacaguuuggaauuguaaaaguucauucaaacuuucuuccccguuuaacuaugaagaaaaugaauauugagcaaugacaucggcacacaagaagugaaauggaagugaggggaggguuucuggauauaccacgauugauuuucccuaaugauuugacuaauaugaaugaaauaggaggauauaauagaagcugucuguuuaaaaaggugauggaccaggagggacuuccaguggagggaggggaacaccaaccuauucacaaaaccuuuggccccaaauuuguccuaccuauaauaugugcagggauaauauauggggcagagauucagguacaaguuaaccaaugacuuccccaacuuuagaagacccccgcccccaugggagaucuaaauccugacacucuuagugauauucugcuaugcuugcaaacaagacacuagcauaacuguccagcagccaguggaaacagauacagagucccacagccaaacauuaggcagaacucugggagacuuggggaaggaucgaaagagucagaggggucaagaacaccacaagaagcucuacagaggcaacuaacuugagcccauggggcucacagagacuaaaccaccaaccaaagagcaugcagaggcuggauauggaccccuuagacauuuguagcagauguacagcuuggucuucaugugggccucuuaaaaauuugacuggggguugucucugccucuguuaccugcuuuugaugccauuccccuagcugggcugccuugucuggccucaaugggagagaauacauuucgaccugcuaugauuugauaugccagguagauugguacccauggggguucucugaggagaaggugagguggcacugagggagcaguaugugagggcaggccuagcaguaugugagggcaggccuagggagagaggagguagaaggguuacaucaggauguaaaguaaauuaaaagaaaaggugaaaggcuaaaccaauauuggguuaagcacugaucacccucauguauagcuuugcagacaguucuuaaaaauugaccacaaacuucucaaacucaaggacaugagaguacaacacucaugacuuucauucauguccaaggagagaccuggaagaaaauugucccaagguucuaaaauuucauuacaaucugaaguaaaaucugaaaacacauuuuauguuuccuuaguuaauaaaucauagccucgaaggaaaacaaagaaaccuuuucuuucuuucuuucuuucuuucuuucuuucuuucuuucuuucuuucuuucuuucuuucuuucuagauaaagucaugaucuugucuuguguaccuucaaagacccagaccuaaaugguccuucugucuugccuuucaaauagucaggacugauggcauguaauaaguaauaagggcuggaaaguaaaguaguaugcugcucaugccuacauuguauaccucacuggcaaacagaucaaggacuaggccuuagccuuggaggcaagaucuaggcauauuacaguauuucaauuaauuugucuggaucuacucuuacagggggaugaagagagaaugaaacuauaacaagaaacaaagaagguacauggaaagucauaaaggauuugguaacuaugcuggauucucuucugugcucauacauacuggcuuuuaugucaggaagucauugaaauauauugccuggguuccucccucaucccuuucacucaacaauccuccuccuuugcagagguaagccaacuaaaacugugacaaaaauaucaucaauuacuuauuggauuucaaagagcaauuuuccauuugacuauauuuugaagucaaucacagcacuugccuauauaugcaagagaucuagcacacuuuaaguuuacagauuauuuuugauauuaaaggaaauugcugauauuuaugaagacaacucacuuuuauaaaauaaaacugaacuuugccaugacuuaggauaagccaauaauguguaggcaaauauguaauuccuauuccccugaaggcuuauuggugacaucuuuuucuuuuccuguuuaaaaggaaaaaaaucuacugaccuuccuaggaaccucucacaguccucacacugugugugggugucauuacagccaagugccaucuuauuucacauggcuuagugaucauugcugaagaaguggaggaaagagugugagagacagaggaacagcaagcuuucugugagacugggucuccuagaaaugccagagagauuacacccauagagucucaucaacauggcugccuaaauaagaccugaacaaugacaacaccaauggccauacuaacaugcaacuggggaagauaaggagguucacacuagaggaagaacuauggacaauagggaaaugauaagaacuggagaaaugguuuucccugaggaagaacuccccaauuguuaucugcuauaaaguggucagcccuggcauaagaugcauacagguaacacuauauggacugaccagguuuacaauaucacagugaaugcuauguguuucauauauacaagcuaucuaucuaucuaucuaucuaucuaucuaucuaucuaucuaucuaucuacaauuaaauaacaaagaugccaugaauuuggaugaaagcaaagaggguuacaugggaagaguuggggagagagaaagggggucauguucuaauuguaacuuagaaaacaauuuuaauuacuauaaaaagcauucauagguuuagcauaauucauagaaacaagcucucuaugauaaaugauucuacuuaacaccuugauacuugguaccauccugugguaagauagguucucagaaaaaaauguauugauacuuaaauauuuauuucucuuuccaggucaaaauuugauagugauuucaaauauauggaaauuauugcuaaaacuuaguauaggcugaguauuugaacacucacaggaaauucaugacauugauauuuuugccaucauuuuauagguuagaauaccaaaaaccaaaacuauuuaucauuuuugccaaggagauaaaauguagcuuggaaaauagcagccuaucuucaaagucggguccuuguuuuauagaaaucucuuucuagcaccacauuauuauuaugcuauugucaagucucugggauccaaggggaaaauaggagauggugcagcucuucuucacuggucugggaaagaucacaaugugcuuacauagacaccauggaugaaacauauuucuaaauguacccaaggaaaggggguuuugagguacaaggcaggcuggcagccacaguuccaacaaaugugguauuggguauguggccaagaaggaaaguagcaaaugacaccucuuuuuacuugacccuaagucucagaucuccuacugcagggugguggacuguaagguaugguugagccaaaggcuugaugcccuggagacccugaagauuuaguaggagcuucgccugcucucagcaccaauccccugucauauagccauagcccccuauagauuugugguuaucaguagcugaagggcaaugcccaagcccuuccacauauagaugaagcaucucuaacaucucggaccaagaggcaugacuacagucauguaagcucaaaacagaguucucuaugccaaugagguaccuagaggucgagagggcauuccaauaagcuuccuuucccauacauuucucccugcaaaagguauaucaucucaugccaacccugagaagugggguaugguucuacagauccauuuuccaccaugacaauaauaaacuguuugggaccauggaaugccucuuuuuuuauugugaucaacagugggaagacauggagaaggccuucgccuacagagucacagucuagucucugaaagaaggcaucuuugcauucucagccacgaucaccaccaagccugccacuaucaagccaaagacaauuucugcagggacuagcuggagcuccucccccauguccaagauccugagaacccacaguucuggggagcaccgaaccaguacggagucaaacucccccauccagucuccacaaguggccgugcucaguggugggacagacuugugaugacacaacccuacauccuacaacaugugaaaggauaugacuguuuggaaauucucuugccaaaugaacacaucaacuaaauuucagaggagcauucaggggagaagaaucucucagucugucaguaccuuaguauccacaagucgacauuuguugaacauaaaaaaaugaaaagagcagaauuucugagugugagagguugacaaugaggcuucugacaaagcuucauguuucaaauauaauauucaaugucauguuuuucuuuuucucagcacauuuuuugaaaaggcaagugcuuucuggcucugcuggauauuugugaagacacggaucacaugagaacauaaaacuuuguaagcuuuaaagccuugcuucucguccgaguguggcaguggaacaacagcaucuccaucuuugaggggcuuguuaaaauuuuggaccauuuccuuugucccacaaccugccagaucagaaaggacguuuugacgagcugcccaugugauuccaguagacacuguuuaaaaguguugcuguagagugccgcuauaacaggaacuugagaacuuaacauaacugauguuaugacgcaaguaccauucccuaaugcuccugcaaucuuuucauaucaccucaaguuguagggacagccaaccauaaaauuauuucuguuucuacaucauaacuguaauuuuucuaccguuauggauuguacuauaaauaucuaauaugcaggauagucuuaggcaaucgcugugcaagggucauuuguccccaccaaggguucaugacccacagauugugaacuacccauuuagacccuaaaagcucagcacauagacaguacacaacaaagacaaagaucugauccaucaaaguucauaguucuagaaccaucucuaaaugcaccaccuuuggauuuuuggcuucuguaguucugcuuuggcuaacuguucuuacuaacacaauuccggaggugguuucacucugagaaagguucaggauuauacaggaucaugaauacccaguguugucucuacccagcugauaaagacuuucuauugucuuaaacccauguccaugcacucuucucugguggacaacccacaacauuagcuaauacuuucacaccucucauaagagcuuuuauuuuuaauuaaauuuuaauuuugcaugcaaaauaauguuuuuauuaugacauuauauauauuuauccauauaugcauaaauauauacauauaugucauuacauauacauauauauaaugucuauauauguauauaacaaaucauuguucuuauuuguuuaccccuuacuccucuacccuucuccaaccucuucuuuuuggucuccuuucuccuccuaaauaaaccucccuucugauuucaugacccaugugaccuaacguuuauaaggcuaccuauuuuucuguacccagagcaugugacuaaacaauuugucccuucucaucauuuucugggcacuccacacuccaauccagagaagcuaucuccuaaucuacucuugaaguaacaguuugaaaauuagaucaccaugcuggcucuuuaaguaaaaccuagccuuccuauuuacugcacaggugcaggccauaccagucagaaaagggaagagccccaccagauaacugaacccuccugauaacuagguuuggagcccaaacacccaagccacugacaccaccacccuacugccugcucccacuucuugcacuugccucuacgcaggugacucuccagagcacaggugcaggccaggcuaaugagaaugaguaagaggcccaucugcacucagaaaccuccuaugcccuugguuuggauccccaaggcacacucuguagacauccuuucuguguuuuaucacccacagagcucaguuaauauuuuuaacaaaaccauagaggaaaaauuuccuaaccuuaagaaggacauguuucuaaaggcagaaaaaucucuuaagacacaaauggauugaauuggaaaagaaagucccuggucaacuaauaaucaaaacacugaacaugcagaacaaagaaaaauauuaaaagcugcaagagaaaaaaggccaaauaacaugaaaagguagaauuauuagaauuauauuuaauuucuuaacagagacccuaaaagccagaauagccuggacauaugucuuacaggcucugagagaccauagauaccauccuagacucgucuaacaagcaaaacuuaaaauaaaaagauuuauuuuuauaugaguauaccacuggucucuucagauucaccagaagaaggcaucagaucacauuacagauguuugugaggcaccauaugguugcugggaauugaacuuaggaucucggugcucuuaaucacugagccaucucuccagcccgccagcaaaacuguucauccucauagauggguaagacaagauacugcaugacaaagucaaauuuaaacaaaaucuacucauaaauccaggcauaucgagguacaaauggaaaucaacaacccuaggagguuaacuacacccaugaagaaauaaauaagcucauacaaaaauuagagggaaacacacacacacacacacacacacacacacacacuagcacuaccauaaacaacaacaaaauaauaagaauuaacacuuauuaaucauuaguaucucucaauaucaguggacucaauuccucaaaaggcacaggcuaacagaaugaauaccaaagcaggauuuauccguuuguuacauauaagaagcacaccucaucaucaaagcuagauauuaccuaagaguugaggguuuggaaaaagauuuuccaagcaaauguacccaagaaacaagcuguuguaucuguuguaauauaagacaaaucgacuucaaaacaaaaauuaaucaaguagacagaggacacuucauauuuaccacaggaaaaccccaccaagaugaugucucaauucuaaacaucuaugccccucaaagcaaggacacccacauuuguaaaaccacacaucaaaacacauguauuaagucgggcgugguggcgcacgccuuuaaucccagcacuugggaggcagaggcaggcagauuucugaguucgaggccagccuggucuacaaagugaguuccaggacagccagggcuauacaaagaaacccuguguugaagcccccccccaaauauguauuuacagugggagacaucaggucauucagacaaaaacuuaacagagaaauaauggaguuaacagacuaacagacuuaacguggacuuaacaguuaucuacagaacauuucacccaaauaaaaacaauauacauucuucucagaaccccaugaaacuucuuuuucaaaauugaccacagacucuguuacaaagcaagucucuacagauccaagaaaacuggaacaacucccccaucucaucagaccaucauagauuaaagaugaauuuuaucaacaacagaaagaacaaaaagcuuaaaaacuuauguaaacugaacaacucucuacugaaugaccccugggucaaacagaaauaaaggaagauauuaaagacuuucuagaacucaaugaaaaugaaugcacaacauacacaaaccuauggcacacaaugaaagcagugcuaagcggaaaguucauaacacuaagaaccuucauauagaaauuagagagauuuaauacuagcaacuuaacagcaccccuaaaagcucuagaauaaaauaagcaaauacacccaagaggaguagauggcacgaaauaaacucggggaugaaaucaguaaaauagacacaaagagagcaauacaaagaauuaaugaaacaaaggguuaguucuuugagaaaaucaacaagacaaaaucaacaagacagacaagccauuauccaaaccaacuaaaaggcagagagagagagagagagagagagagagagagagagagagagagagaauaucuuaacaaaaucagaaaagaaaaggggggcaugauaacagauacugaggaaauacaaagaaucauuaggucgcacuucaaaaacuuacuccacaaaauuagaaaaccuaaaagaaauggacaacuuucucaauagauaccacuuaucaagaucagauaaacaauuaaaauagaccuaugaccuauaaggaaggaaucacaggaagcagucauuugaaaaggcucccaacuccccuaccucacaaaaaggaaacccucaaacaagagcuaauaucaauaauccuuaaauuauuccacaaaauagaaauagaaggaacaucaccaaauucauuucaugaggccacagucaccaugauacccaaucugcaaaaagacucaacaaggaaagagaauuacagaccaauuuuugcccaugaacauugguauaaaaauacucaagaaaauaucuacaaacuaaauccaauauacauaaaagauguguucaacaugaccacauaggacacaucacagagauucagggauggcucuacauaugaaaaucugucaauguaauucaccauacaaacagugaaaaaauacccgacgugaucaucucauuagauacuacaaaagccuuuaacaaaacacaacacuccuucaugauacaagacuuagagagaucaaggauauaagggacauaccuaaacauagcaaagacaauauacaguagguggauagccaacaucauguuaaguagagagaaacucaaugcaauuuuacaaaaaucagggacaagacaagacuguccauaguacuugacauucuagcuagaguaauaagacaaccaaaggagaucaagaggaauacaauuuggaaaggacuaagucaauguauuauuauuuucagaugauauaguagcauauacaagcagcccauaaaauuuuuccaggaaacucauacaggugauaaauaccuucagcaaagcagcuggauacaagauuaacuaaaauaaauaauaaauaaauaaauaaauaauucaguauccuuauaaacaucaaauggguugagaaaaaagaaaucaaggaagcaacacacuucaugguagauaaagauaauauaaaauauauuggggcaacuguaacuaagaaacugaaaagcuuauaugauaaaagcuuuaggucuuugaagaaagaaauugaagaugucagaagauuaaaaguucucuuaugcucauggaccugugagauuaacauaguaaaaaaaagcaaucuacagacucaaugcaaaccccaucaaaauucuaaaaaaauuucuuuacagaccuggaaagaacaauucucaacuucaaauggaaaaccaaaaaaccaaggauagcuaaaacaauccuguacaaaaaaagaacuuccuaaaacuaccacaccccugauucuaagcucuuugacagagcuaucaucauaaaaacacaugguauaggcauaaauacagacaacuugaucagugcaaucgaaucaaagacccagauguaaauccgcacaccuguggacaccugauuuuuuauuaaagaagacauaauuauacaauggagaaauaaagcaucaucaacaaauggugcugguuuaacuggauguuggcaaguagaagacugcaaauagauccauguauauuacccugcacaaaacucaaggccacaugaaccagagacaccaacaucaaaacauugcaccugauagaaaagaaaggaauagccuugaaugcauuggcacagaagacaacuuccugaagagaacaucaauagugcaggcauuaagauggacauuuaauaaauguuuccucaugacacugaaaagcuucuguaaggcaaaggacaccaucaaaaggacaaaauauucaagguacagaaugggaaaagauauacacuaacuccacaccugacagacagcuaauuucuaaaauauguaaaaucaagcaagcaagcaagcaagcaaacaaacaaacaaaaaacccucaagaaucuagacaucaacaaacaauccaauuuaaaaaugggguacagcuaguugugguggugcacaccuuuaaucccagcacucagaggcagaggcaggcagaucucugagugaggccagacuggucuauagagauauguccaggaaagacagagaaacucugucuuaaagcuccuuaagacccaacuauaccaauccugagcauauacccacagaacaguccacaaggacaguugcucaacuauguuuauaccagcuuuaucaugaaauuugcaggaaaugaacagaucuagaaaaaagucauccauagugagacccagagagaaaaacacgguacacauucaguuauaagaguauauucucuguaaaguaaagaaucagacucagagaggcuaagcaacaaggaaggcucaguguguggggggcacaugaauuucccuuggaagauaaaguagaauagauauuguggguagacuagguuggguagggaggaggacaagaagaaucauguggggaagggggaggacauggagcaagcgagagagagagggagagagagagagagagagagagagagagagagagagagagagagagagagagagagagagaacuggaaagaggagaaggacauuuuggcagugaugcagaaaccuaacacaauggaagcucccagcaaucuacaagggugaccuagcuaggaucccuagaaagugaggacacagaaccuuaacuagccaucuccuauaacuagauauccaguggagggauuaggauaccaacucaaccucagcacauucaacuuauaauuuuuccugccuacaagauguacuguggugauacaaaaauugggggaguggccaaccaauggcugguucagcuugaaacccauagagagagagcccagggcugauacugacuggaaggucaggacccagagagaggcuggauaucccagacaccucagauagaaccaaacacuauugaaaaaaauaagucaaugaaaugauuccuaguuagguucugcuguacuuguagacaggagucuagcaccaucaucaugagagugguuucaucuaguaacugaugcaaacagaugcagagacccacagccuaacauuaaguggagcuagaggaauucuuggaaggagggcggaguuguaggagcuagcugggucaaggaugccacagaaaagcccacagaaucaacuaaccuggauuaauaggggcucacagacacugaaucaauagccagugagccuacauggacugaccgaugcccucugcauauauauuaugguuuuguagcuuagucuucugugggacuuguaacaguggaagcaaggggugucucugucucuuuuggccugcuuuugggacccuccucuuuuccacugaggcaccuuguccagccuucauacaagggaaggggccuagcuuuguugcaauuugauaugucauguuugguugcuaucccugugaagacugcccuuuuccgaugggaaauggaggaggaaugggugaacugggaggaggcaaaggggagguucaggaggagugaggggagaggagacaggguaagcugugaacuggauauaauauaugaggagaaaaaauaaauuaauaaaagagagagcaacagcaauccacguuuucuuugccuaagcagauucuacacagguaguagacguaaacaauuccuuuucugaaacuuuaugcauguguuuaaguacaugaaauucaguuuuccagcaaugauaucaugcgcuauauauagcuacauaacuuguuugguuuaaaugaccucauuuacuuccuuguuauuaaccuaaaagcaccuuuccacuauacaaaauuuucucuaaaguacguuuugaggaaacaucugcuuuuacacaauggcagauuccaaucagcuucccugcaaagguguggugcuguugaauacuccagcaguaguaaccuugccuucccacaguuuuguuuucugggagggcacaucuaggcaacgccuugauuuugcuugucaauuuaccugaggcuuuugggagggccaggugaugguuauguauacacagaaagagggucagauccaagcacacggcuagagcgcggcaggaguggugagguccagaucccaugggccuagagcaucugacaaagacagaaaacuggagccaggcucacauggaaaucgggaaaaccaugcugagaagacaacagcaaggacuuacugcauuguuccuuucuuuuaaaaaaauuagauauuuucuuuacuuacauuucaaauuuuauccccuuucuuccuuuccccucugaaagcuauccugucucacccccuccccccugcuuacuaacacauccacuccuacuucccuguccuggcauucccauacacugggacaucgagucuucacaaggcuaagggccucuccucucauugaugucccacaaggccauccucuacuacauugagucccuccguguguacucuuugguuggugguuuagucccugggaguucuggggguacuaguugguucuuauuguuguuccuccuauggggcugcaaaccuagucagcuccuuggguccuuucucuagcuccucuauuggggacccugugcucaguccaaugcauggcugugaaccuccacuucuguauuugucaggcacugggagagccucucaggagacagcuguaucaggcuccucucagcaaguacuuguuggcauccacaauagugucuggguuugguaauuguauauaguacggauccucagguaggacagacacuggaggccauuuccuucagucucugcuucccacuuucucucuguaucucuucccauggguauuuugaucccccuucuaagaaggaucgaaguauccacaccguggucuuccuucaucuugagauucaugugaucugugaauuguaucuuggguauuccgagcuuuugggcuaauauccaccuaugaguucacagcagccuuauuuauaauagccagaagcaggaaauaacccagaugucuuucaacauagaaauguauuauuccuuucuuacaguaagagggagauuucuauuuccuuacagggcagugacauaauaguagcauccuucugauuggcuaaauuguucuucaaucacaguugagaaguuauaucugugagagaggguugacugcuaggagaacaaugauuaguaaguuggaaggacaaacgaauaccuuuucuguccucauuguacggaucaauacaaaucuacuucuaaagccggacgugguggcgcacaccuuugaucccagcacuggggaggcagagggaggcagauuucugaguucgaggccagccugguauacaaagugaguuccaggacagccagggcuacacagagaaacccugucucaaaaaacaaaaaacaguuccaggacucagcagaacuuaggaaauuagucugaacaggugagagggugcgccagagaaccggacagcuucugggauaggcggaagcacagagccacugaggcagcacccuuggcgggcugcagacagccggccaccguccggaccagaggacagguguccgccuggcuugggaggcggccucagccucagcagcagcggucgccauccugguuccaggacuccguggaacuuaggaaauuaguccgaacaggugagagggugcgccagagaaccagacagcuucugggauaggcggaagcacagagccgcugaggcagcacccuuggcgggccacagacagccggccaccguccggaccagaggacagguguccgcuuggcuugggaggcggccucagccucaggagcagcggucgccaucuugguuccgggacucccuggaacuuaggaauuuagucugcacaggugagagucugcaccacagaagcugacagcuucugggaacugccaaagcaacacagcuucggagaaaggcccuguuuugggccuucuuuuucggccaggaggagguccaaaaacaagauaucugcgcaccuucccuguaagagagcuugccagcagagagugcucugagcacugaaacucagaggagagaaucugucucccaggucugcugauagacgguaacagaaucaccagaagaacaaucucuaaacagagucaacucuaacuacuaacuccagagauuaccagauggcaaaagguaaacguaggaaucuuucuaacaggaaccaagaccacucaccaucaucagaacccagcacucccacuucguccaguccaggacaccccaacacacccgaaaaccuagaccuagauuuaaaagcauaucucaugaugaugguagaggacaucaagaaggacuuuaauaaaucacuuaaagaaauacaggagaacacugcuaaaaaguuacaaguccuuaaagaaaaacaggaaaacacaaucaaacagguagaaguccuuacagaaaaagaggaaaaaacauccaaacaggugauggaaaugaacaaaaccauacuagaccuaaaaagggaaguagacacaauaaagaaaacucaaagugaggcaacacuggagauagaaacccuaggaaagaaaucuggaaccauagauuugagcaucagcaacagaauacaagagauggaagagagaaucucaggugcagaagauuccauagagaacaucggcacaacaaucaaagaaaauggaaaaugcaaaaagauccuaacucaaaauauccaggaaaucgaggacacaaugagaagaccaaaccuacggggauaauaggaauggaugagaaugaagauuuucaacucaaaggaccaacaaacaucuucaacaaaauuauugaagaaaacuucccaaaucuaaagaaagagaugccuaugaacauacaagaagccuacagaacuccaaauagacuggaccagaaaagaaauuccucccgacacauaauaaucagaacaacaaaugcacuaaauaaagauagaauacuaaaagcaguaagggaaaaaggucaaguaacauauaaaggcaagccuaucagaauuacaccagauuuuucaccagagacuaugaaagccagaagagccuggacagauguuauacagacacuaagagaacacaaauuccagcccaggcuacuauacccagccaaacucucaauuaccauagauggagaaacuaaaguauuccacgacaaaaccaaauucacacauuaucucuccaugaauccagcccuucaaaggauaauaacagaaaaaaaccaauacaagaaugggaacaacgcccuagaaaaaacaggaagguaaucccucaacaaaccuaaaagaagacagccacaagaacagaaugccaacuuuaacaacaaaaauaacaggaagcaauaauuacuuuuccuuaauaucucuuaacaucaauggucucaacucccuaauaaaaagacauagacuaacaaacuggcuacacaaacaagacccaacauuuugcugcuuacaggaaacacaucucagagaaaaagauagacacuaccucagaaugaaaggcuggaaaacaauuuuccaagcaaaugguaugaagaaacaagcuggaguagccauccuaauaucugauaagauugacuuccaacccaaagucaucaaaaaagacaaggaaaggcacuucguucucaucaaagguaaaauccuccaagaggaacucucaauacugaauaucuaugcuccaaauacaagggcagccacauucauuaaagaaacuuuaguaaagcucaaagcacacauugcaccucacacaauaauagugggagacuucaacacaccacuuucaccaauggacagaucauggaaacagaaacuaaacagggacacacugaaacuaacagaagugaugaaacaaauggaucugacagauaucuacagaacauuuuauccuaaaacaaaaggauauaccuucuucucagcaccucaugguaccuucuccaaaauugaccacauaauaggucacaaaacaggccucaacagauucaaaaauauugaaauugucccauguauccuaucagaucaccaugcacuaaggcugauuuucaauaacaaaauaaauaauagaaaaccaacauucacauggaaacugaacaacacucuucucaaugauaccuuggucaaggaaggaauaaagaaagaaauuaaagacuuuuuagaguuuaaugaaaaugaagccacaacguacccaaaccuuugggacacaaugaaagcauuucuaagagggaaacucauagcucugagugccuccaagaagaaacgggagagagcacauacuaucagcuugacaacacaucuaaaagcucuagaaaaaaaaggaagcaaauucacccaagaggaguagacggcaggaaauaaucaaacucaggggugaaaucaaccaaguggaaacaagaagaacuauucaaagaauuaaccaaaggaggaguugguucuuugagaaaaucaacaagauagauaaacccuuagcuagacucacuagagggcacagggacaaaauccuaauuaacaaaaucagaaaugaaaagggagacauaacaacagaucaugaagaaauccaaaacaccaucagauccuucuacaaaaggcuauacucaacaaaacuggaaaaccuggacgaaauggacaaauuucuggacagauaccagguaccaaaguugaaucaggaucaaguugaccuucuaaacagucccauauccccuaaagaaauagaagcaguuauaaauagucucccagccaaaaaaagcccaggaccagacggguuuagugcagaguucuaucagaccuucaaagaagaucuaauuccaguucugcacaaacuuuuucacaagauagaaguagaauguacucuacccaacucauuuuaugaagccacuauuacucugauaccuaaaccacagaaagauccaacaaagauagagaacuucagaccaauuucucuuaugaauaucgaugcaaaaauccucaauaaaauucucgcuaaccgaauccaagaacacauuaaagcaaucauccauccugaccaaguagguuuuauuccagggaugcagggaugguuuaauauacgaaaaucuaucaauguaauccauuauauaaauaaacucaaagacaaaaaccacaugaucaucucguuagaugcagaaaaagcauuugacaagauccaacacccauucaugauaaaaguucuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaagggauacaaauuagaaaagaggaagucaaaauaucacuuuuugcagaugauaugauaguauauauaagugaccccaaaaauuccaccagagaacuccuaaaccugauaaacagcuucggugaaguagcuggauauaaaauaaacucaaagaagucaauggccuuucucuauacaaaaaauaaucaggcugagaaagaaauuagggaaacaacacccuucucaauagucacaaauaauauaaaauaucucggcgugacucuaacuaaggaagugaaagaacuguaugauaaaaacuucaagucucugaagaaagaaauuaaagaagaucucagaagauggaaggaucucacauguucauggauuggcaggaucaacauuguaaaaauggcuaucuugccaaaagcaauuuacagauucaaugcaauccccaucaaaauuccaacucaauucuucaaugaauuagaaguagcaauuugcaaauucaucuggaauaacaaaaaacccaggauagcaaaaacucuucucaaggauaaaagaaacucugguggaaucaccaugccugaccuaaagcuuuacuacagagcaauugugauaaaaacugcaugguacugguauagagacagacaaguagaccaauggaauagaauugaagacucagaaaugaacccacacaccuauggucacuugaucuucgacaagggagcuaaaaccauccaguggaagaaagacagcaucaucaacaauuggugcuggcacaacugguuguuaucauguagaagaaugcgaauugauccauacuuaucucccuguacuaaggucaaaucuaaguggaucaaggaacuucacuuaaaaccagagacacugaaacuuauagaggagaaaguggggaaaagccuugaagauaugggcacaggggaaaaauuccugaacagaacagcaauggcuugugcuguaagaucgagaauugacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcaccugaaaaaauguucaacauccuuaaucaucagggaaaugcaaaucaaaacaacccugagauuccaccucacaccagucagaauggcuaagaucaaaaauucaggugacagcagaugcuggcguggauguggagaaagaggaacacuccuccauuguuggugggauugcaggcuuguacaaccacucuggaaaucagucuggcgguuccucagaaaacuggacauaguacuaccggaggauccagcaauaccucuccugggcauauauccagaagaugccccaacugguaagaaggacacaugcuccacuauguucauagcagcccuauuuauaauagccagaagcuggaaagaacccagaugccccucaacagaggaauggauacagaaaaugugguacaucuacacaauggaguguuacucagcuauuaaaaagaaugaauuuaugaaauuccuagccaaauggauggaccuggagggcaucauccugagugagguaacacauucacaaaggaacucacacaauauguacucacugauaaguggauauuagcccaaaaccuaguauacccaagauacaagauacaauuuccuaaacacaugaaacucaagaagaaugaagacugaaguguggacacuaugccccuccuuagaagugggaacaaaacacccuuggaaggaguuacaaagacaaaguuuggagcugagaugaaaggauggaccauguagagacugccauauccagggauccaccccauaaucagcauccaaacgcugacaccauugcauacacuagcaagauuuuaucgaaaggacccagagguagcugucucuugugagacuaugccggggccuagcaaacacauaaguggaugcucacagucagcuauuggauggaucacagggcccccaauggaggagcuggagaaauuacccaaggagcuaaagggaacugcaacccuauagguggaacaacauuaugaacuaaccaguaccccggagcucuugacucuagcugcauauguaucaaaagauggccuagauaggccaucacuggaaagagaggcccauuggacacgcaaauuuuauaugccccaguacaggggaacgccagggccaaaaagggagaguggguggguaggggaguggggguggguggguaugggggacuuuugguauagcauuggaaauguaaaugagcuaaauaccuaauaaaaaauaaaaacaaaaaacaaaaaacaaacaacaacaacaacaaaaaacccaaaacaaacaaaucuacuucuaacaaucucacuagacuaugggggcuggaaaccagggcccccuucacuguuauuacuacuuucuucuuuuccaacauuacaagaccaugauacuauuuuugggaaaugucauauggaaaauugacaccuguucugcucauauguucccacacaggacaguuucaacagaauuugcauggcuuuucccaugucuuauuucuuuuguuccuacuuguugauauaaaagcaaagcaaagcaaagcaaagcaaagcaaagcaaagcaaagcaaagcaaagcaaagcaaagcaaagcaaagcaaaacaaaacaaaacaaaacaagccucacgaaacaguauagugucacuguauuagagaagaucagaaucccagccccagccacacagaagcaaugugagugagccucaggcccuugcuccugcuaaguucccauuggugaauuccuaaguggaaccauacuguggcuacugugaaaaacacggaagcggccacacaaaaaccacccugaaguaucaaauucuguuucuuuagcuguauuccuaggauuacuggaucauguggggauuuuacuuuaagucagaguguacauacugcuguguucugcucuguaggagagaagagaagagagagagagacauagauuugguaccuugugaucucaacuuuauuauuuuuuucuuaaaagugauagcaucaaaagaaccuaucuuuuuaaacuucugugggucucagaacauauaaugugugaauuuacuuagaaauguggauaaacuauugcaauuaucagguaauaauuuugccuaauagaaauagaguuacauacaucuuagaccagauuucugaguucacucagaucucagcuuguacuuguagaacaggauaucaaaaaagcucuuagaaguagaaaaaguguguguguguguguuuauguauguauguauuugugugugugcuugucuguguguuugugugcuuguguauaugugcauguauguguuuaugaguaggugugcuuauguauauguaugcaugcauguauacauuuguguuuuuguaaaguuuguauauuucuaccauacauauacacgcuagaaaauaucuggacuguguugcuaaguuuuuugagguaauaauuccugggaagagauuacuugacuuucugaagcucuaacauagacuacguauaauuugaaaggccaugagaguuaguauaacuuggaugcaaagacgacugugaauauaacacucuuuccagcucuaugacauaauauauuccaucuauuuccuucugggugcauaguccuacacugggguccuugauugccuguguucauuaaugaguuugugugucuacaucuggauaaaaagcuacggaaagacagacuauuguacaugucacacgaggaaacuggggcacuccuggauguugcagggauggcaaagaggggagggauaagaggugcagaaaaaaaaaaugagaauauaaaucccuaucuucaguuaaguggauucaaucuaaucuaaaagucuuucacuuugcuaaauauuugguauaggcuaguaguggagggugucugggccaucuggagacuucaggacaaacaggauggugaagagcuaggucccugggaagcugcagaaagaguucggcuuuccacagucuguggguacuuaacugaauuacacaugcacuuucaugaauaugauggggucuaaauuuacuauauuacauacguggccauauauuuauuucuauuguaauuuaacuuaccaguaggagaagcaacacauuuguugucuuguuuacuauaauguaauuguucauaagaaagauaaucuaaauuggauguacuuaaauugcugugugggaacaguucugccuuggggggacauuuguuagucucuaccagcacaucaguucaacagguuagugauaguggucagaauucugcuaugcacaagagagaccccuaagaauuccugaccccaaaccccaaaaauacuagcugguuuuguaugucaacuugacacagcuggaguuaucacagagaaagaagcgucccuugaggaaaugccuccaugagaucuagccguaaggcauuucucaauguggguggugccaugccuggacugguaguccuggguucuauaagaaagcaagcugagcaagccacacaaagcaauccaguaaggagcacuccuccauggccucugcaucagcuccugccucuaaguuccuguccugugugaguuccuguuccagcuuccuuuggugaugaacagcaauguggacguguuagcucaauaaacccuuuccucccuaacuugcuucuugaucauguuuugugcaggaacacaaagccugacuaagacacccaauuaggcccagccgcaaucuuguguuagaacaaucacuuacuuuacagagagaaacugagcaccaaaggggccagugauaugugcaaagucgcucugagcauauaagagagguagguccucuaguguauuuacaucgugccauuuagcuucaaagagcuaguauuccacauggaacugcugaaaaaccaauauugcugggaaccccuugcacuucagauaugguacauaacugcacaguaaacaucaguccacagcuagccauaguuaggccaggcaagaagaaacagagaauuuaauuauguaacaccuauucagauauuguaugaaaaccauuuucauaucugaccaaguuacugucccauguacuggaucuucacacaccucacuacugccuggagguuguaagaacuugcauuucuagaaccuacaaagggaaguucuaagugugucugcccugaggcccaaagacgggcauuuccaaauguuccauucagaugcugacauagcuaguagcuagcuuucucagaccacugagaaacacugccuaacauuugauggggaaauggcaaaugcuggucuaagaguaaacuugaaucucacccuucauguaaucucacuuuaagagugauuaauguuaauucacacaaaggacuauaaucauauaagugguaauuuagacauaauucaaauuucaaaaagucuaaaaaggaagaaaucuguagguuuuugauagccuauagagacaacauuaaggaauaaucauauguuauuugaggagaagagugauacccuaaauauaauaaguauuauauaaaaauauuauauauaaaauacccuaaauuggaagacauccaaacaaauaauauaaauauuauucuguaugcauucuuuauuuuuaacauuuuauuucugcuagacugagugaccuugaucuauugggccugccgagcuguaucuacggggaucguugcuauugacaucaguaauauaaaaucaggccuuuagggagccguaacugucucuucaaaugauuugggaaaauguguacaucuucaaucaauuaaauacaggacaaauuuagucaaucacaaaugaucaacacgccccuguucauugugcuuagcaguaugaaaauggcacccaggcaaauugauuucgguaacacuccuuuucauucuuuuaauucaauagugagaagaauauaaggcaguuuucaauguucuauccacaguaauccuguaguuagucugccuuacugcuuacaccagagcucauuugaagacacccaagcaaaugacaggaaacuuuuaacucuggucaagucccaaucacagacccuugcuugccaaggacacaaaggaagccaaacuuucaaacaugcugcauugaucuccaacuuuuuaaaucccucugucauuuuaaaugaggugcacucgguugugucaucaucucgguuuuaauugugugaaaauuuccugccaaucucacaccgcugcggcaaccucaccuugcuacuugcccugcaaguucugcagugugccguucugaguaugccguuuuaacuaguucuugcagcaggacacaaagcgagauagucugauagaaccaguucuccucugguuuuaccuuuacucuuagaugaguuaagggucacaucaaaccagggcucagcccgccagaucuccuaagcacagccccuccugacccaaugcaguuaacccaaccucauucagcgcuaguaucaaaugacacuggagcugcugcaguaugcaucccgagacuaaguaggcaggauuuauuaucagcagaaguccccuaacuaccagguuauucaagcuccguucuugucacaaacaggcgcggcggaagacacagugcagcagacucagagcucauuuacaagacaagcgaauucucaguuagagacaagggcagcgcggcagcgaacugcaguaaaucuuuucacgcucacagcaacaucuaacaaugcucuccugcaacgccucagaucaaacgaauccuacuugguuuaaacaucaaaucaacaccauaaaaaaggcuucauuagcaaaguucaauuuaggauguuuuuaaucgugucuuaauucuagaaccagugcgagacuuuccaugcuuauucaagcaugcugacagaauuggaaccucuuagaauugccuaccugcaccuaucagccuggcugacaggagcccgccaaaggauuaaaaaaaaacaaaacccaaaacauaaaaucaugcaaaaaaauauuuacccccgaaagauguauguaguuaaagcucagcuuccugcagccucgauagccccugaaguguuaaucugaagaaacaguuccaugaguuuccacaggccgguagugagucuccuacacuugaccuagacagacuuacau

SEQ ID NO: 13 - DNA, 123 bp, Mus musculus
gtttcattggtcagtttaacagcaaatgccttgggttactctgaactcggggccatcaaatccctaaggacactaagagctctgagacccctaagagccttatcacgatttgaagggatgagg

SEQ ID NO: 14 - DNA, 7597 bp, Mus musculus
gtaagaaaaaggaaaactctgcagcgttgtatattgtcaaagctaggctgagttcaacttaactaacgaaaaacacgtgcatgcaaaaggaatggcaaccctttgcaaacttgctactttacccttttctctgttgcatatttacttcttggtgatatgcaagagaaaatcggcctctttgaaaatgatttaatatcatttatctgctttgctaattaaaatgaccttagttcataatcgatcttgggagtttccttataattcctaatacaaagggggaggggcagatactctcttaaagaactaagttgagtcatgtaataattacctagagataattttgtttcatatcgttctcctctatgacagcccatcagtacttaagggatcctatggaaagtaatgtgaatcacaaatgtgtatgaatacaaaggaaaaaatgaagaattgttaaatgttttgtctttacaatgccaaaattctcattatttgaatatatccaagggcagatattaaccattgactggagtataataatactgcctcaactgtaactaaattaatgacattgaataagtaagacactaatttaattactataaatacatacacatcttatgacaatacagctgataaggaaaaagaacatgtatttttattcattgccatacatggctcgtcaaccttaacttaaacctcggttctcagttacacagagttttatgttgctcttttgagcaaagcattattcccctctccataattcaacacgtatcagatttttgcatttattggctcattgttatgatgattatttcaaagcattatacaatcatttatagaagatgtgccgtgtgaaaattatttttttattaagatccaaaatttacgctctttaaaccaatcagatgaaatgtataaggcaaagagtgctcattgtcctgacacttacaaaccaaggctccaacaaacaggctcctctctgcaccacatagagggctttcagcctgtgtccccccataaaaacctattataaattttattatactatactgtaagaaacctgtccaatttttaatttctctagcacatatgaaaacttctcttcagtagatccaagtaagcacaaaggagctttgattctcacacaagaaatcacatttgtattaaaaatgtatcataaattttctcccaattatgcaaaacttaaatgcttttccaattaaaagagcactttcgtttcagaatagcaatttcagttgtcaaggaaaacattgtttttatacattttatataaaaatacatgagctaaatttaaattcacatttttcaactttttatggtttttttatgtttctttttctttcgcattttttaacaatccagccattacctctcctccctgtccccctcctatagtttctcatctcattcctcctcccccttgcctctgagaggatgctccctccctcactaggcctccctcttccccagggcttcaagttcctcaaggattatacacatcttctcccactgagaccaggccaggcagtcctctgcttctgcccagcctgtgtatgttcctgcttggtagctcagtctctggaagctccctggggtctgggttagttgggactgctggtcttcctatggagttaccctccccttcaacttcttcaatccttcccctaattcaaccacaggtatccagacttcagtccaatggttgagtgtaaatattggcatctgtctctgtcagctgttgttaggggctcagaggacagccatgctaggctcctgcctacaagcagcacaccataacatcagtaatagtgtcaggcctttaatgaataatgctacgtatataaggttgttagattatacttcaactttgatcttttagaatattattaaatccagtcgtttattttttatatgtaatattgactttccataacaaatgagtctattttccttttgtgtagaaataactttatcaattattgttaataatgcttttgtcaattattgttgatatgcttctcttttttaaaactggagtcatcaaaacaaaaattctgggtagatattacgaagctgactccttggtcagcttggcacatagtgagaccacaaatatctcaaggtcacggcaattcctcaccaccagtttggcattgtgaagtcaaaaccaaccttctgttgattctggtttttgtatttctagtatgagacattttctactttgtaagagtatataactgtggatggcggcgaggttgggcatgatgatgattgtaagcgggaagtgagctagagtatcttcagaaactctcactttatcctccttggcagcatagaaccgcaatcgctgtgtccgagtgtcaaccaggcagtcattttgttttgggttttttgtcactctttcaaagcatgtgcttctacgcaacactaccaaacacagcatgctgcatagtgcttgagaaggagttagaaagtaacaaacgagttatcatcacgttgccctttgtgttttgcatgtcttatgcacacttttggctgacagcttttgaacatttattgtatttcaaatttccagtccaaatttttttttcaacttgtgaaattgaacggaatgaaccgatgtcgtgaatacctagggtcaaataaaacttgtatttaaattcgtagttttaatttcccaagctgggaaaatcgtaaaaaccttttccaaagaactcaagtcttagttgctagggaaacaggcagtgagcatcatatacaaaaagtaacaccaaatgttctgtcatatcagctttctaactaataataaactatatatttctattttatataggataatcttgctccaacttggatggggtggagcggtggttcctcccctcagccctttattatgggtactgtattaccccttttgctacctttaatccttgcactgtgacttatgtgtagtgggattgagggagggagtgggaagggtacaattgcaccacagtagggacaatacaggatttatttccaaatccactacttttaatgagcttaaacttcttttgggaaaaaaaaagttatctctgacttaccatctgtggattataaccccagaagtacatatctttattacgtttcactgaatatgatttagctatttatacttcattgtccatttatggggaaattactcaattggtgagggtgggggaccctggtgtaggatgctgatgaaaacgttttcatttgtcaagctcatggtagtgacagagcatatagtccttattttttcaacacactgctctggtccctcaatgggccagtcacattccatcagttgatcgttgatgtgtgcgagcagtggctaaaggtacaacaggccaggtatctcagggttgccaatggttatgatcattctcatctttattgcataaaaatgtgttatttgcagaaagtagcaaggcaagatccctgtgaaacaagggaatacaaaaaaaaaaaaagatgtgctttaagttataaaaccaaaacatgtgaaaagtcaacttcattgaagtataaagaataggatatgcatgaaaaacaaaaaaatcatgagcactaagaaattggtgtataagccaactccttgtaagctaccccaattaacttcccagaatcttagaaggcatcacagtgcaccccaaaataaaaagccaaactgacacttctgcttcctcttaaaatgtaggagtcttggataagaaagataatttttattgtttggaagaaaaaaaaattgtttggataattgaggcatttatctatcaaaaatatttatcttaataaaatttcacaacactgatttagttgttggcttttctaaaaattttttatatttcatattaagaactcatgatttttactttccattttttaaattcttattcacatatggtttttctctatttcttagaaaagctatagaacccatggtttccggtgacttaaaaaactaatctaaatgtcttcacttagatgatactttcaaatgcactgaaatttctaatatcaacaagaatatttgcctggtcctaatttttcactgatttaataaaaagtatgaaccctaaagaagaaatagacttgaagaactggttgtgtgacaatacagaaattctgctgggagatgtccttttaaaacattgttagaagagacaacctctacaatccacccattaagcatacttctctcttagacatctccttttatgtaccttataacctcaatgtgttctttccaattgacttagaccaacacttcccagcgcatcccacatgggagccaattactgactctccctagagactgcaaagaattaatattgtagaaccaagggatggttgggctcttgggagaggcaatccgtttgtgatcttttgctctggatgttaatgaaatcgcaactttaagtggattttcagtggcaaatcctctgatcctatgccaaatgttctctaagacaaacatccttgtaaaataaatgtctcactgggccaaatctatggcaaatttgcacgttttcctgaactgcattcctatatagtatttgccatcctgaattcactaatgggcattacttttaattcaaaaccagtcccttcttcaaaggaaatctctcccatttattacattatgcaaactgctttcttatgcagtggttaaatccttagccaggcaagtatgaggactggaatttggatatccagaaccctcagaaatgtcggatgggcatagtagcttacatgtaattccagagctagaaagatgaaactagccctgtcctcaagctctgaattcagttggtgcaataaataagaaagaatccccccccccgacccctacatctctttcctctacatctatacatgtatttcccatacagctctatgcttccacatatatgctcacatatgtgcatgcacacttgcacacatatgtacacttgacacattgaagcatcataatctaacaattggaatataagaaaatatttaactttcacacagagcagtcagagaaaaccataagaggttgaaactcttgaaaaaacttgcaggataaacagaaaagagtatgagatgccaattctggtctactttctgaacctaacttgttttaccttcattagtctaattttccaaatgaaccccaagcaccaaattgtccttattgctctttccagtactaaattataattcctcaattcgaaggcaaacactctcatctttgttaaggatgtgtagagttagactcaataaacgacatgtatatttgagctaaagcctggaggagggagattatttcaagggcaagtacttggcagggagtttcaaagaaagaaggctctcaattctcagactaacaccttagcgtggagtgactgtcacagaggagggtgaagtgtatgtcaccagttagggaagctgaaaggggaaatgtatcaggcttgtgagaatccttcagcagccaagtctagcacctgagcacaatccccagaactgaccccacatggtggaaaggagaggaataattcctgcaaattttcctgtgacctccacccaagtgctatagaaaatgcatgcatgcccacatgcacacacaaataaacatagttgcaaactgttttgaggaaaataacctcacaaactgtcgagtgatgtaaatgccaaagaaagagaaatgttttctaatggctagagaaccattaaggaatttttcaaaatgggacatgggatagataaatttagtatccatactgaaagaaggcaagcaaataaaatctgataagaatgtaattcttagtaaccgaggacagagcgaagatagagaacagggccaatggccaaggtggaaaggtttgaaggaagcagcatgaaacctacagacttgtaccaaaatgttcagtgtcatgagtgttaaaagtgaaaagcttgcatgttagtatggatttcatatcctcggcagacagagcacctcactgtgagtgggagatgaagtattcagaaatgagaaacaactactcaatttcagtgttcatatctcaaatccaataaacaactttaggggtacaattttttaaaaaattacattaaaatgtttttaaatctcttcttaataatttaaaaattaaattgaaaataactttaaaaagtaatatatacaggaaagcctgtgtgctaattttttagggaggccataaagggagatagttgctcattaatttctacacatcagcctatctttggcttctgccttgatagcgcactctgaattatcttcttcatgttcatccctcatctttattgttactggtttcatttcccttggccacatagcccactattttgtattccccaatggatattgttccttacaaagttcagccagggctcagaagtacaaggaattggctcttatacttctgtcagacaggcaaaaacttctaaaattatactataataaaaatcaaagagatgatattcataattaaactaacaaaagtggcaggccccccctcccccaacatgagtagaattaatctgacgtccatgttcaagtctgaaacacacttgccaattaagagcacattagggccagcctttatctccctcttagttactaatgtgcagttcaatggtgagctatagagaaggaagccaagactaccatatgtcaaatataaaaaaaaaaaatcccattttaaatctgtagtcccgaattaaggacaagagagagggaaatatctttgacattagaaaatggagaaaatattttagcacaggactttactcagtcacatcagagttgataagtacgtatgacatccctctttttcctgttttcctgagaaaatgatctctctagtgtttcatttaagataagtttattgaattaaactcagtaaatgaaacaactgacatgactggagcttgaaataaacgatgtgatgatctactgaaatacatgatgctaaattgtcttgcttcttatgcaaaaactactattagttatagcaatgcatggataattaaggccaaaaatatattagatgttaaaaatagttttatatttatacatctgaattttaatttatatttaaagtatattggtccaatcaattcatgcccaaatgttttagttctattctttgagatactgttttgttttgggatttttttttatgagctaatctcttgcctaggagttcctacttctctctcctccttttattttttctaataaactacacatgtgtcttcatccaggagctaacttctcccattttgcttttcctttagcaccttttttatattagatttctttcttttctccatctctttgcatattgcctatatttcttttcctaagcataatatttaaaaaagactgagttttatgttaagattatttctgctttgctcttacacagataggataagtagtcttgatagaaaataaatcaatgattcctagggggatgtctttttgcttttaatcaataaggattctgacttctctttctctccatttgtgtattag

SEQ ID NO: 15 - DNA, 282 bp, Mus musculus
gtggttgtgaatgccctgttaggagcaattccatccatcatgaatgtgcttctggtttgccttatattctggctaattttcagcatcatgggcgtaaatttgtttgctggcaaattctaccactgtgttaacaccacaactggtgacatatttgagatcagcgaagtcaataatcattctgattgcctaaaactaatagaaagaaatgagaccgcccggtggaaaaatgtgaaagtaaactttgataatgtaggatttgggtatctttctttgcttcaagtt

SEQ ID NO: 16 - DNA, 64 bp, Mus musculus
gataatcttgctccaacttggatggggtggagcggtggttcctcccctcagccctttattatgg

SEQ ID NO: 17 - RNA, 123 nt, Mus musculus
guuucauuggucaguuuaacagcaaaugccuuggguuacucugaacucggggccaucaaaucccuaaggacacuaagagcucugagaccccuaagagccuuaucacgauuugaagggaugagg

SEQ ID NO: 18 - RNA, 7597 nt, Mus musculus
guaagaaaaaggaaaacucugcagcguuguauauugucaaagcuaggcugaguucaacuuaacuaacgaaaaacacgugcaugcaaaaggaauggcaacccuuugcaaacuugcuacuuuacccuuuucucuguugcauauuuacuucuuggugauaugcaagagaaaaucggccucuuugaaaaugauuuaauaucauuuaucugcuuugcuaauuaaaaugaccuuaguucauaaucgaucuugggaguuuccuuauaauuccuaauacaaagggggaggggcagauacucucuuaaagaacuaaguugagucauguaauaauuaccuagagauaauuuuguuucauaucguucuccucuaugacagcccaucaguacuuaagggauccuauggaaaguaaugugaaucacaaauguguaugaauacaaaggaaaaaaugaagaauuguuaaauguuuugucuuuacaaugccaaaauucucauuauuugaauauauccaagggcagauauuaaccauugacuggaguauaauaauacugccucaacuguaacuaaauuaaugacauugaauaaguaagacacuaauuuaauuacuauaaauacauacacaucuuaugacaauacagcugauaaggaaaaagaacauguauuuuuauucauugccauacauggcucgucaaccuuaacuuaaaccucgguucucaguuacacagaguuuuauguugcucuuuugagcaaagcauuauuccccucuccauaauucaacacguaucagauuuuugcauuuauuggcucauuguuaugaugauuauuucaaagcauuauacaaucauuuauagaagaugugccgugugaaaauuauuuuuuuauuaagauccaaaauuuacgcucuuuaaaccaaucagaugaaauguauaaggcaaagagugcucauuguccugacacuuacaaaccaaggcuccaacaaacaggcuccucucugcaccacauagagggcuuucagccuguguccccccauaaaaaccuauuauaaauuuuauuauacuauacuguaagaaaccuguccaauuuuuaauuucucuagcacauaugaaaacuucucuucaguagauccaaguaagcacaaaggagcuuugauucucacacaagaaaucacauuuguauuaaaaauguaucauaaauuuucucccaauuaugcaaaacuuaaaugcuuuuccaauuaaaagagcacuuucguuucagaauagcaauuucaguugucaaggaaaacauuguuuuuauacauuuuauauaaaaauacaugagcuaaauuuaaauucacauuuuucaacuuuuuaugguuuuuuuauguuucuuuuucuuucgcauuuuuuaacaauccagccauuaccucuccucccugucccccuccuauaguuucucaucucauuccuccucccccuugccucugagaggaugcucccucccucacuaggccucccucuuccccagggcuucaaguuccucaaggauuauacacaucuucucccacugagaccaggccaggcaguccucugcuucugcccagccuguguauguuccugcuugguagcucagucucuggaagcucccuggggucuggguuaguugggacugcuggucuuccuauggaguuacccuccccuucaacuucuucaauccuuccccuaauucaaccacagguauccagacuucaguccaaugguugaguguaaauauuggcaucugucucugucagcuguuguuaggggcucagaggacagccaugcuaggcuccugccuacaagcagcacaccauaacaucaguaauagugucaggccuuuaaugaauaaugcuacguauauaagguuguuagauuauacuucaacuuugaucuuuuagaauauuauuaaauccagucguuuauuuuuuauauguaauauugacuuuccauaacaaaugagucuauuuuccuuuuguguagaaauaacuuuaucaauuauuguuaauaaugcuuuugucaauuauuguugauaugcuucucuuuuuuaaaacuggagucaucaaaacaaaaauucuggguagauauuacgaagcugacuccuuggucagcuuggcacauagugagaccacaaauaucucaaggucacggcaauuccucaccaccaguuuggcauugugaagucaaaaccaaccuucuguugauucugguuuuuguauuucuaguaugagacauuuucuacuuuguaagaguauauaacuguggauggcggcgagguugggcaugaugaugauuguaagcgggaagugagcuagaguaucuucagaaacucucacuuuauccuccuuggcagcauagaaccgcaaucgcuguguccgagugucaaccaggcagucauuuuguuuuggguuuuuugucacucuuucaaagcaugugcuucuacgcaacacuaccaaacacagcaugcugcauagugcuugagaaggaguuagaaaguaacaaacgaguuaucaucacguugcccuuuguguuuugcaugucuuaugcacacuuuuggcugacagcuuuugaacauuuauuguauuucaaauuuccaguccaaauuuuuuuuucaacuugugaaauugaacggaaugaaccgaugucgugaauaccuagggucaaauaaaacuuguauuuaaauucguaguuuuaauuucccaagcugggaaaaucguaaaaaccuuuuccaaagaacucaagucuuaguugcuagggaaacaggcagugagcaucauauacaaaaaguaacaccaaauguucugucauaucagcuuucuaacuaauaauaaacuauauauuucuauuuuauauaggauaaucuugcuccaacuuggaugggguggagcggugguuccuccccucagcccuuuauuauggguacuguauuaccccuuuugcuaccuuuaauccuugcacugugacuuauguguagugggauugagggagggagugggaaggguacaauugcaccacaguagggacaauacaggauuuauuuccaaauccacuacuuuuaaugagcuuaaacuucuuuugggaaaaaaaaaguuaucucugacuuaccaucuguggauuauaaccccagaaguacauaucuuuauuacguuucacugaauaugauuuagcuauuuauacuucauuguccauuuauggggaaauuacucaauuggugagggugggggacccugguguaggaugcugaugaaaacguuuucauuugucaagcucaugguagugacagagcauauaguccuuauuuuuucaacacacugcucuggucccucaaugggccagucacauuccaucaguugaucguugaugugugcgagcaguggcuaaagguacaacaggccagguaucucaggguugccaaugguuaugaucauucucaucuuuauugcauaaaaauguguuauuugcagaaaguagcaaggcaagaucccugugaaacaagggaauacaaaaaaaaaaaaagaugugcuuuaaguuauaaaaccaaaacaugugaaaagucaacuucauugaaguauaaagaauaggauaugcaugaaaaacaaaaaaaucaugagcacuaagaaauugguguauaagccaacuccuuguaagcuaccccaauuaacuucccagaaucuuagaaggcaucacagugcaccccaaaauaaaaagccaaacugacacuucugcuuccucuuaaaauguaggagucuuggauaagaaagauaauuuuuauuguuuggaagaaaaaaaaauuguuuggauaauugaggcauuuaucuaucaaaaauauuuaucuuaauaaaauuucacaacacugauuuaguuguuggcuuuucuaaaaauuuuuuauauuucauauuaagaacucaugauuuuuacuuuccauuuuuuaaauucuuauucacauaugguuuuucucuauuucuuagaaaagcuauagaacccaugguuuccggugacuuaaaaaacuaaucuaaaugucuucacuuagaugauacuuucaaaugcacugaaauuucuaauaucaacaagaauauuugccugguccuaauuuuucacugauuuaauaaaaaguaugaacccuaaagaagaaauagacuugaagaacugguugugugacaauacagaaauucugcugggagauguccuuuuaaaacauuguuagaagagacaaccucuacaauccacccauuaagcauacuucucucuuagacaucuccuuuuauguaccuuauaaccucaauguguucuuuccaauugacuuagaccaacacuucccagcgcaucccacaugggagccaauuacugacucucccuagagacugcaaagaauuaauauuguagaaccaagggaugguugggcucuugggagaggcaauccguuugugaucuuuugcucuggauguuaaugaaaucgcaacuuuaaguggauuuucaguggcaaauccucugauccuaugccaaauguucucuaagacaaacauccuuguaaaauaaaugucucacugggccaaaucuauggcaaauuugcacguuuuccugaacugcauuccuauauaguauuugccauccugaauucacuaaugggcauuacuuuuaauucaaaaccagucccuucuucaaaggaaaucucucccauuuauuacauuaugcaaacugcuuucuuaugcagugguuaaauccuuagccaggcaaguaugaggacuggaauuuggauauccagaacccucagaaaugucggaugggcauaguagcuuacauguaauuccagagcuagaaagaugaaacuagcccuguccucaagcucugaauucaguuggugcaauaaauaagaaagaauccccccccccgaccccuacaucucuuuccucuacaucuauacauguauuucccauacagcucuaugcuuccacauauaugcucacauaugugcaugcacacuugcacacauauguacacuugacacauugaagcaucauaaucuaacaauuggaauauaagaaaauauuuaacuuucacacagagcagucagagaaaaccauaagagguugaaacucuugaaaaaacuugcaggauaaacagaaaagaguaugagaugccaauucuggucuacuuucugaaccuaacuuguuuuaccuucauuagucuaauuuuccaaaugaaccccaagcaccaaauuguccuuauugcucuuuccaguacuaaauuauaauuccucaauucgaaggcaaacacucucaucuuuguuaaggauguguagaguuagacucaauaaacgacauguauauuugagcuaaagccuggaggagggagauuauuucaagggcaaguacuuggcagggaguuucaaagaaagaaggcucucaauucucagacuaacaccuuagcguggagugacugucacagaggagggugaaguguaugucaccaguuagggaagcugaaaggggaaauguaucaggcuugugagaauccuucagcagccaagucuagcaccugagcacaauccccagaacugaccccacaugguggaaaggagaggaauaauuccugcaaauuuuccugugaccuccacccaagugcuauagaaaaugcaugcaugcccacaugcacacacaaauaaacauaguugcaaacuguuuugaggaaaauaaccucacaaacugucgagugauguaaaugccaaagaaagagaaauguuuucuaauggcuagagaaccauuaaggaauuuuucaaaaugggacaugggauagauaaauuuaguauccauacugaaagaaggcaagcaaauaaaaucugauaagaauguaauucuuaguaaccgaggacagagcgaagauagagaacagggccaauggccaagguggaaagguuugaaggaagcagcaugaaaccuacagacuuguaccaaaauguucagugucaugaguguuaaaagugaaaagcuugcauguuaguauggauuucauauccucggcagacagagcaccucacugugagugggagaugaaguauucagaaaugagaaacaacuacucaauuucaguguucauaucucaaauccaauaaacaacuuuagggguacaauuuuuuaaaaaauuacauuaaaauguuuuuaaaucucuucuuaauaauuuaaaaauuaaauugaaaauaacuuuaaaaaguaauauauacaggaaagccugugugcuaauuuuuuagggaggccauaaagggagauaguugcucauuaauuucuacacaucagccuaucuuuggcuucugccuugauagcgcacucugaauuaucuucuucauguucaucccucaucuuuauuguuacugguuucauuucccuuggccacauagcccacuauuuuguauuccccaauggauauuguuccuuacaaaguucagccagggcucagaaguacaaggaauuggcucuuauacuucugucagacaggcaaaaacuucuaaaauuauacuauaauaaaaaucaaagagaugauauucauaauuaaacuaacaaaaguggcaggcccccccucccccaacaugaguagaauuaaucugacguccauguucaagucugaaacacacuugccaauuaagagcacauuagggccagccuuuaucucccucuuaguuacuaaugugcaguucaauggugagcuauagagaaggaagccaagacuaccauaugucaaauauaaaaaaaaaaaaucccauuuuaaaucuguagucccgaauuaaggacaagagagagggaaauaucuuugacauuagaaaauggagaaaauauuuuagcacaggacuuuacucagucacaucagaguugauaaguacguaugacaucccucuuuuuccuguuuuccugagaaaaugaucucucuaguguuucauuuaagauaaguuuauugaauuaaacucaguaaaugaaacaacugacaugacuggagcuugaaauaaacgaugugaugaucuacugaaauacaugaugcuaaauugucuugcuucuuaugcaaaaacuacuauuaguuauagcaaugcauggauaauuaaggccaaaaauauauuagauguuaaaaauaguuuuauauuuauacaucugaauuuuaauuuauauuuaaaguauauugguccaaucaauucaugcccaaauguuuuaguucuauucuuugagauacuguuuuguuuugggauuuuuuuuuaugagcuaaucucuugccuaggaguuccuacuucucucuccuccuuuuauuuuuucuaauaaacuacacaugugucuucauccaggagcuaacuucucccauuuugcuuuuccuuuagcaccuuuuuuauauuagauuucuuucuuuucuccaucucuuugcauauugccuauauuucuuuuccuaagcauaauauuuaaaaaagacugaguuuuauguuaagauuauuucugcuuugcucuuacacagauaggauaaguagucuugauagaaaauaaaucaaugauuccuagggggaugucuuuuugcuuuuaaucaauaaggauucugacuucucuuucucuccauuuguguauuag

SEQ ID NO: 19 - RNA, 282 nt, Mus musculus
gugguugugaaugcccuguuaggagcaauuccauccaucaugaaugugcuucugguuugccuuauauucuggcuaauuuucagcaucaugggcguaaauuuguuugcuggcaaauucuaccacuguguuaacaccacaacuggugacauauuugagaucagcgaagucaauaaucauucugauugccuaaaacuaauagaaagaaaugagaccgcccgguggaaaaaugugaaaguaaacuuugauaauguaggauuuggguaucuuucuuugcuucaaguu

SEQ ID NO: 20 - RNA, 64 nt, Mus musculus
gauaaucuugcuccaacuuggaugggguggagcggugguuccuccccucagcccuuuauuaugg

SEQ ID NO: 21 - DNA, 18 bp, Artificial Sequence
  Description of Artificial Sequence: Synthetic oligonucleotide
gatgctctccgtctgttt

SEQ ID NO: 22 - DNA, 18 bp, Artificial Sequence
  Description of Artificial Sequence: Synthetic oligonucleotide
ttcatgatgctctccgtc

SEQ ID NO: 23 - DNA, 18 bp, Artificial Sequence
  Description of Artificial Sequence: Synthetic oligonucleotide
ttttgttcatgatgctct

SEQ ID NO: 24 - DNA, 18 bp, Artificial Sequence
  Description of Artificial Sequence: Synthetic oligonucleotide
ttactttttgttcatgat

SEQ ID NO: 25 - DNA, 18 bp, Artificial Sequence
  Description of Artificial Sequence: Synthetic oligonucleotide
tggtgttactttttgttc

SEQ ID NO: 26 - DNA, 18 bp, Artificial Sequence
  Description of Artificial Sequence: Synthetic oligonucleotide
acatttggtgttactttt

SEQ ID NO: 27 - DNA, 18 bp, Artificial Sequence
  Description of Artificial Sequence: Synthetic oligonucleotide
acagaacatttggtgtta

SEQ ID NO: 28 - DNA, 18 bp, Artificial Sequence
  Description of Artificial Sequence: Synthetic oligonucleotide
atatgacagaacatttgg

SEQ ID NO: 29 - DNA, 18 bp, Artificial Sequence
  Description of Artificial Sequence: Synthetic oligonucleotide
atctgatatgacagaaca

SEQ ID NO: 30 - DNA, 18 bp, Artificial Sequence
  Description of Artificial Sequence: Synthetic oligonucleotide
tagaaatctgatatgaca

SEQ ID NO: 31 - DNA, 18 bp, Artificial Sequence
  Description of Artificial Sequence: Synthetic oligonucleotide
ttagttagaaatctgata

SEQ ID NO: 32 - DNA, 18 bp, Artificial Sequence
  Description of Artificial Sequence: Synthetic oligonucleotide
tgttattagttagaaatc

SEQ ID NO: 33 - DNA, 18 bp, Artificial Sequence
  Description of Artificial Sequence: Synthetic oligonucleotide
tagtttgttattagttag

SEQ ID NO: 34 - DNA, 18 bp, Artificial Sequence
  Description of Artificial Sequence: Synthetic oligonucleotide
atatatagtttgttatta

SEQ ID NO: 35 - DNA, 18 bp, Artificial Sequence
  Description of Artificial Sequence: Synthetic oligonucleotide
tagaaatatatagtttgt

SEQ ID NO: 36 - DNA, 18 bp, Artificial Sequence
  Description of Artificial Sequence: Synthetic oligonucleotide
caaaatagaaatatatag

SEQ ID NO: 37 - DNA, 18 bp, Artificial Sequence
  Description of Artificial Sequence: Synthetic oligonucleotide
atacaaaatagaaatata

SEQ ID NO: 38 - DNA, 18 bp, Artificial Sequence
  Description of Artificial Sequence: Synthetic oligonucleotide
ctatacaaaatagaaata

SEQ ID NO: 39 - DNA, 18 bp, Artificial Sequence
  Description of Artificial Sequence: Synthetic oligonucleotide
tcctatacaaaatagaaa

SEQ ID NO: 40 - DNA, 18 bp, Artificial Sequence
  Description of Artificial Sequence: Synthetic oligonucleotide
tatcctatacaaaataga

SEQ ID NO: 41 - DNA, 18 bp, Artificial Sequence
  Description of Artificial Sequence: Synthetic oligonucleotide
attatcctatacaaaata

SEQ ID NO: 42 - DNA, 18 bp, Artificial Sequence
  Description of Artificial Sequence: Synthetic oligonucleotide
agttggagcaagattatc

SEQ ID NO: 43 - DNA, 18 bp, Artificial Sequence
  Description of Artificial Sequence: Synthetic oligonucleotide
atccaagttggagcaaga

SEQ ID NO: 44 - DNA, 18 bp, Artificial Sequence
  Description of Artificial Sequence: Synthetic oligonucleotide
accccatccaagttggag

SEQ ID NO: 45 - DNA, 18 bp, Artificial Sequence
  Description of Artificial Sequence: Synthetic oligonucleotide
gctccaccccatccaagt

SEQ ID NO: 46 - DNA, 18 bp, Artificial Sequence
  Description of Artificial Sequence: Synthetic oligonucleotide
ccagcgctccaccccatc

SEQ ID NO: 47 - DNA, 18 bp, Artificial Sequence
  Description of Artificial Sequence: Synthetic oligonucleotide
gaaccagcgctccacccc

SEQ ID NO: 48 - DNA, 18 bp, Artificial Sequence
  Description of Artificial Sequence: Synthetic oligonucleotide
gggaggaaccagcgctcc

SEQ ID NO: 49 - DNA, 18 bp, Artificial Sequence
  Description of Artificial Sequence: Synthetic oligonucleotide
ataataaagggctcaggg

SEQ ID NO: 50 - DNA, 18 bp, Artificial Sequence
  Description of Artificial Sequence: Synthetic oligonucleotide
ccataataaagggctcag

SEQ ID NO: 51 - DNA, 18 bp, Artificial Sequence
  Description of Artificial Sequence: Synthetic oligonucleotide
gtaatacagtacccataa

SEQ ID NO: 52 - DNA, 18 bp, Artificial Sequence
  Description of Artificial Sequence: Synthetic oligonucleotide
gggtaatacagtacccat

SEQ ID NO: 53 - DNA, 18 bp, Artificial Sequence
  Description of Artificial Sequence: Synthetic oligonucleotide
ttaaaggtagcaaaaggg

SEQ ID NO: 54 - DNA, 18 bp, Artificial Sequence
  Description of Artificial Sequence: Synthetic oligonucleotide
aaggattaaaggtagcaa

SEQ ID NO: 55 - DNA, 18 bp, Artificial Sequence
  Description of Artificial Sequence: Synthetic oligonucleotide
agtgcaaggattaaaggt

SEQ ID NO: 56 - DNA, 18 bp, Artificial Sequence
  Description of Artificial Sequence: Synthetic oligonucleotide
gtcacagtgcaaggatta

SEQ ID NO: 57 - DNA, 18 bp, Artificial Sequence
  Description of Artificial Sequence: Synthetic oligonucleotide
cataagtcacagtgcaag

SEQ ID NO: 58 - DNA, 18 bp, Artificial Sequence
  Description of Artificial Sequence: Synthetic oligonucleotide
ctacacataagtcacagt

SEQ ID NO: 59 - DNA, 18 bp, Artificial Sequence
  Description of Artificial Sequence: Synthetic oligonucleotide
ccccactacacataagtc

SEQ ID NO: 60 - DNA, 18 bp, Artificial Sequence
  Description of Artificial Sequence: Synthetic oligonucleotide
cctcaccccactacacat

SEQ ID NO: 61 - DNA, 18 bp, Artificial Sequence
  Description of Artificial Sequence: Synthetic oligonucleotide
ccctccctcaccccacta

SEQ ID NO: 62 - DNA, 18 bp, Artificial Sequence
  Description of Artificial Sequence: Synthetic oligonucleotide
ccaatccctccctcaccc

SEQ ID NO: 63 - DNA, 18 bp, Artificial Sequence
  Description of Artificial Sequence: Synthetic oligonucleotide
ccttcccaatccctccct

SEQ ID NO: 64 - DNA, 18 bp, Artificial Sequence
  Description of Artificial Sequence: Synthetic oligonucleotide
agtacccttcccaatccc

SEQ ID NO: 65 - DNA, 18 bp, Artificial Sequence
  Description of Artificial Sequence: Synthetic oligonucleotide
ataatagtacccttccca

SEQ ID NO: 66 - DNA, 18 bp, Artificial Sequence
  Description of Artificial Sequence: Synthetic oligonucleotide
gtgcaataatagtaccct

SEQ ID NO: 67 - DNA, 18 bp, Artificial Sequence
  Description of Artificial Sequence: Synthetic oligonucleotide
ctgtggtgcaataatagt

SEQ ID NO: 68 - DNA, 18 bp, Artificial Sequence
  Description of Artificial Sequence: Synthetic oligonucleotide
gatgctcactgcctgttt

SEQ ID NO: 69 - DNA, 18 bp, Artificial Sequence
  Description of Artificial Sequence: Synthetic oligonucleotide
tatatgatgctcactgcc

SEQ ID NO: 70 - DNA, 18 bp, Artificial Sequence
  Description of Artificial Sequence: Synthetic oligonucleotide
ttttgtatatgatgctca

SEQ ID NO: 71 - DNA, 18 bp, Artificial Sequence
  Description of Artificial Sequence: Synthetic oligonucleotide
ttactttttgtatatgat

SEQ ID NO: 72 - DNA, 18 bp, Artificial Sequence
  Description of Artificial Sequence: Synthetic oligonucleotide
tggtgttactttttgtat

SEQ ID NO: 73 - DNA, 18 bp, Artificial Sequence
  Description of Artificial Sequence: Synthetic oligonucleotide
acatttggtgttactttt

SEQ ID NO: 74 - DNA, 18 bp, Artificial Sequence
  Description of Artificial Sequence: Synthetic oligonucleotide
acagaacatttggtgtta

SEQ ID NO: 75 - DNA, 18 bp, Artificial Sequence
  Description of Artificial Sequence: Synthetic oligonucleotide
atatgacagaacatttgg

SEQ ID NO: 76 - DNA, 18 bp, Artificial Sequence
  Description of Artificial Sequence: Synthetic oligonucleotide
agctgatatgacagaaca

SEQ ID NO: 77 - DNA, 18 bp, Artificial Sequence
  Description of Artificial Sequence: Synthetic oligonucleotide
tagaaagctgatatgaca

SEQ ID NO: 78 - DNA, 18 bp, Artificial Sequence
  Description of Artificial Sequence: Synthetic oligonucleotide
ttagttagaaagctgata

SEQ ID NO: 79 - DNA, 18 bp, Artificial Sequence
  Description of Artificial Sequence: Synthetic oligonucleotide
tattattagttagaaagc

SEQ ID NO: 80 - DNA, 18 bp, Artificial Sequence
  Description of Artificial Sequence: Synthetic oligonucleotide
tagtttattattagttag

SEQ ID NO: 81 - DNA, 18 bp, Artificial Sequence
  Description of Artificial Sequence: Synthetic oligonucleotide
atatatagtttattatta

SEQ ID NO: 82 - DNA, 18 bp, Artificial Sequence
  Description of Artificial Sequence: Synthetic oligonucleotide
tagaaatatatagtttat

SEQ ID NO: 83 - DNA, 18 bp, Artificial Sequence
  Description of Artificial Sequence: Synthetic oligonucleotide
taaaatagaaatatatag

SEQ ID NO: 84 - DNA, 18 bp, Artificial Sequence
  Description of Artificial Sequence: Synthetic oligonucleotide
atataaaatagaaatata

SEQ ID NO: 85 - DNA, 18 bp, Artificial Sequence
  Description of Artificial Sequence: Synthetic oligonucleotide
ctatataaaatagaaata

SEQ ID NO: 86 - DNA, 18 bp, Artificial Sequence
  Description of Artificial Sequence: Synthetic oligonucleotide
tcctatataaaatagaaa

SEQ ID NO: 87 - DNA, 18 bp, Artificial Sequence
  Description of Artificial Sequence: Synthetic oligonucleotide
tatcctatataaaataga

SEQ ID NO: 88 - DNA, 18 bp, Artificial Sequence
  Description of Artificial Sequence: Synthetic oligonucleotide
attatcctatataaaata

SEQ ID NO: 89 - DNA, 18 bp, Artificial Sequence
  Description of Artificial Sequence: Synthetic oligonucleotide
agttggagcaagattatc

SEQ ID NO: 90 - DNA, 18 bp, Artificial Sequence
  Description of Artificial Sequence: Synthetic oligonucleotide
atccaagttggagcaaga

SEQ ID NO: 91 - DNA, 18 bp, Artificial Sequence
  Description of Artificial Sequence: Synthetic oligonucleotide
accccatccaagttggag

SEQ ID NO: 92 - DNA, 18 bp, Artificial Sequence
  Description of Artificial Sequence: Synthetic oligonucleotide
gctccaccccatccaagt

SEQ ID NO: 93 - DNA, 18 bp, Artificial Sequence
  Description of Artificial Sequence: Synthetic oligonucleotide
ccaccgctccaccccatc

SEQ ID NO: 94 - DNA, 18 bp, Artificial Sequence
  Description of Artificial Sequence: Synthetic oligonucleotide
gaaccaccgctccacccc

SEQ ID NO: 95 - DNA, 18 bp, Artificial Sequence
  Description of Artificial Sequence: Synthetic oligonucleotide
gggaggaaccaccgctcc

SEQ ID NO: 96 - DNA, 18 bp, Artificial Sequence
  Description of Artificial Sequence: Synthetic oligonucleotide
ataataaagggctgaggg

SEQ ID NO: 97 - DNA, 18 bp, Artificial Sequence
  Description of Artificial Sequence: Synthetic oligonucleotide
ccataataaagggctgag

SEQ ID NO: 98 - DNA, 18 bp, Artificial Sequence
  Description of Artificial Sequence: Synthetic oligonucleotide
gtaatacagtacccataa

SEQ ID NO: 99 - DNA, 18 bp, Artificial Sequence
  Description of Artificial Sequence: Synthetic oligonucleotide
gggtaatacagtacccat

SEQ ID NO: 100 - DNA, 18 bp, Artificial Sequence
  Description of Artificial Sequence: Synthetic oligonucleotide
ttaaaggtagcaaaaggg

SEQ ID NO: 101 - DNA, 18 bp, Artificial Sequence
  Description of Artificial Sequence: Synthetic oligonucleotide
aaggattaaaggtagcaa

SEQ ID NO: 102 - DNA, 18 bp, Artificial Sequence
  Description of Artificial Sequence: Synthetic oligonucleotide
agtgcaaggattaaaggt

SEQ ID NO: 103 - DNA, 18 bp, Artificial Sequence
  Description of Artificial Sequence: Synthetic oligonucleotide
gtcacagtgcaaggatta

SEQ ID NO: 104 - DNA, 18 bp, Artificial Sequence
  Description of Artificial Sequence: Synthetic oligonucleotide
cataagtcacagtgcaag

SEQ ID NO: 105 - DNA, 18 bp, Artificial Sequence
  Description of Artificial Sequence: Synthetic oligonucleotide
ctacacataagtcacagt

SEQ ID NO: 106 - DNA, 18 bp, Artificial Sequence
  Description of Artificial Sequence: Synthetic oligonucleotide
tcccactacacataagtc

SEQ ID NO: 107 - DNA, 18 bp, Artificial Sequence
  Description of Artificial Sequence: Synthetic oligonucleotide
ctcaatcccactacacat

SEQ ID NO: 108 - DNA, 18 bp, Artificial Sequence
  Description of Artificial Sequence: Synthetic oligonucleotide
cctccctcaatcccacta

SEQ ID NO: 109 - DNA, 18 bp, Artificial Sequence
  Description of Artificial Sequence: Synthetic oligonucleotide
cactccctccctcaatcc

SEQ ID NO: 110 - DNA, 18 bp, Artificial Sequence
  Description of Artificial Sequence: Synthetic oligonucleotide
cttcccactccctccctc

SEQ ID NO: 111 - DNA, 18 bp, Artificial Sequence
  Description of Artificial Sequence: Synthetic oligonucleotide
gtacccttcccactccct

SEQ ID NO: 112 - DNA, 18 bp, Artificial Sequence
  Description of Artificial Sequence: Synthetic oligonucleotide
caattgtacccttcccac

SEQ ID NO: 113 - DNA, 18 bp, Artificial Sequence
  Description of Artificial Sequence: Synthetic oligonucleotide
tggtgcaattgtaccctt

SEQ ID NO: 114 - DNA, 18 bp, Artificial Sequence
  Description of Artificial Sequence: Synthetic oligonucleotide
tactgtggtgcaattgta

SEQ ID NO: 115 - RNA, 18 nt, Artificial Sequence
  Description of Artificial Sequence: Synthetic oligonucleotide
cagagaaaauaguguuca

SEQ ID NO: 116 - RNA, 18 nt, Artificial Sequence
  Description of Artificial Sequence: Synthetic oligonucleotide
auauucagagaaaauagu

SEQ ID NO: 117 - RNA, 18 nt, Artificial Sequence
  Description of Artificial Sequence: Synthetic oligonucleotide
uaaaaauauucagagaaa

SEQ ID NO: 118 - RNA, 18 nt, Artificial Sequence
  Description of Artificial Sequence: Synthetic oligonucleotide
aacaauaaaaauauucag

SEQ ID NO: 119 - RNA, 18 nt, Artificial Sequence
  Description of Artificial Sequence: Synthetic oligonucleotide
uuccaaacaauaaaaaua

SEQ ID NO: 120 - RNA, 18 nt, Artificial Sequence
  Description of Artificial Sequence: Synthetic oligonucleotide
uauuauuccaaacaauaa

SEQ ID NO: 121 - RNA, 18 nt, Artificial Sequence
  Description of Artificial Sequence: Synthetic oligonucleotide
uuuguuauuauuccaaac

SEQ ID NO: 122 - RNA, 18 nt, Artificial Sequence
  Description of Artificial Sequence: Synthetic oligonucleotide
auuauuuuguuauuauuc

SEQ ID NO: 123 - RNA, 18 nt, Artificial Sequence
  Description of Artificial Sequence: Synthetic oligonucleotide
augucauuauuuuguuau

SEQ ID NO: 124 - RNA, 18 nt, Artificial Sequence
  Description of Artificial Sequence: Synthetic oligonucleotide
gauguaugucauuauuuu

SEQ ID NO: 125 - RNA, 18 nt, Artificial Sequence
  Description of Artificial Sequence: Synthetic oligonucleotide
uaauagauguaugucauu

SEQ ID NO: 126 - RNA, 18 nt, Artificial Sequence
  Description of Artificial Sequence: Synthetic oligonucleotide
cuaaauaauagauguaug

SEQ ID NO: 127 - RNA, 18 nt, Artificial Sequence
  Description of Artificial Sequence: Synthetic oligonucleotide
aggaacuaaauaauagau

SEQ ID NO: 128 - RNA, 18 nt, Artificial Sequence
  Description of Artificial Sequence: Synthetic oligonucleotide
uucuuaggaacuaaauaa

SEQ ID NO: 129 - RNA, 18 nt, Artificial Sequence
  Description of Artificial Sequence: Synthetic oligonucleotide
acuuuuucuuaggaacua

SEQ ID NO: 130 - RNA, 18 nt, Artificial Sequence
  Description of Artificial Sequence: Synthetic oligonucleotide
uauauacuuuuucuuagg

SEQ ID NO: 131 - RNA, 18 nt, Artificial Sequence
  Description of Artificial Sequence: Synthetic oligonucleotide
ugcauguuuuacuuugga

SEQ ID NO: 132 - RNA, 18 nt, Artificial Sequence
  Description of Artificial Sequence: Synthetic oligonucleotide
guuuuacuuuggaguaaa

SEQ ID NO: 133 - RNA, 18 nt, Artificial Sequence
  Description of Artificial Sequence: Synthetic oligonucleotide
acuuuggaguaaaaauaa

SEQ ID NO: 134 - RNA, 18 nt, Artificial Sequence
  Description of Artificial Sequence: Synthetic oligonucleotide
ggaguaaaaauaauuuag

SEQ ID NO: 135 - RNA, 18 nt, Artificial Sequence
  Description of Artificial Sequence: Synthetic oligonucleotide
aaaaauaauuuagaccug

SEQ ID NO: 136 - RNA, 18 nt, Artificial Sequence
  Description of Artificial Sequence: Synthetic oligonucleotide
uaauuuagaccugauguu

SEQ ID NO: 137 - RNA, 18 nt, Artificial Sequence
  Description of Artificial Sequence: Synthetic oligonucleotide
uagaccugauguuuaaua

SEQ ID NO: 138 - RNA, 18 nt, Artificial Sequence
  Description of Artificial Sequence: Synthetic oligonucleotide
cugauguuuaauaaauau

SEQ ID NO: 139 - RNA, 18 nt, Artificial Sequence
  Description of Artificial Sequence: Synthetic oligonucleotide
guuuaauaaauauucuua

SEQ ID NO: 140 - RNA, 18 nt, Artificial Sequence
  Description of Artificial Sequence: Synthetic oligonucleotide
auaaauauucuuacugau

SEQ ID NO: 141 - RNA, 18 nt, Artificial Sequence
  Description of Artificial Sequence: Synthetic oligonucleotide
uauucuuacugauauaau

SEQ ID NO: 142 - RNA, 18 nt, Artificial Sequence
  Description of Artificial Sequence: Synthetic oligonucleotide
uuacugauauaauuuuca

SEQ ID NO: 143 - RNA, 18 nt, Artificial Sequence
  Description of Artificial Sequence: Synthetic oligonucleotide
gauauaauuuucaaaagg

SEQ ID NO: 144 - RNA, 18 nt, Artificial Sequence
  Description of Artificial Sequence: Synthetic oligonucleotide
aauuuucaaaagggaaua

SEQ ID NO: 145 - RNA, 18 nt, Artificial Sequence
  Description of Artificial Sequence: Synthetic oligonucleotide
cuuuggaguaaaaauaau

SEQ ID NO: 146 - RNA, 18 nt, Artificial Sequence
  Description of Artificial Sequence: Synthetic oligonucleotide
uuuggaguaaaaauaauu

SEQ ID NO: 147 - skipped

SEQ ID NO: 148 - RNA, 18 nt, Artificial Sequence
  Description of Artificial Sequence: Synthetic oligonucleotide
uuggaguaaaaauaauuu

SEQ ID NO: 149 - RNA, 18 nt, Artificial Sequence
  Description of Artificial Sequence: Synthetic oligonucleotide
uggaguaaaaauaauuua

SEQ ID NO: 150 - RNA, 18 nt, Artificial Sequence
  Description of Artificial Sequence: Synthetic oligonucleotide
gaguaaaaauaauuuaga

SEQ ID NO: 151 - RNA, 18 nt, Artificial Sequence
  Description of Artificial Sequence: Synthetic oligonucleotide
aguaaaaauaauuuagac

SEQ ID NO: 152 - RNA, 18 nt, Artificial Sequence
  Description of Artificial Sequence: Synthetic oligonucleotide
guaaaaauaauuuagacc

SEQ ID NO: 153 - RNA, 18 nt, Artificial Sequence
  Description of Artificial Sequence: Synthetic oligonucleotide
uaaaaauaauuuagaccu

SEQ ID NO: 154 - RNA, 18 nt, Artificial Sequence
  Description of Artificial Sequence: Synthetic oligonucleotide
uacugauauaauuuucaa

SEQ ID NO: 155 - RNA, 18 nt, Artificial Sequence
  Description of Artificial Sequence: Synthetic oligonucleotide
acugauauaauuuucaaa

SEQ ID NO: 156 - RNA, 18 nt, Artificial Sequence
  Description of Artificial Sequence: Synthetic oligonucleotide
cugauauaauuuucaaaa

SEQ ID NO: 157 - RNA, 18 nt, Artificial Sequence
  Description of Artificial Sequence: Synthetic oligonucleotide
ugauauaauuuucaaaag

SEQ ID NO: 158 - RNA, 18 nt, Artificial Sequence
  Description of Artificial Sequence: Synthetic oligonucleotide
auauaauuuucaaaaggg

SEQ ID NO: 159 - RNA, 18 nt, Artificial Sequence
  Description of Artificial Sequence: Synthetic oligonucleotide
uauaauuuucaaaaggga

SEQ ID NO: 160 - RNA, 18 nt, Artificial Sequence
  Description of Artificial Sequence: Synthetic oligonucleotide
auaauuuucaaaagggaa

SEQ ID NO: 161 - RNA, 18 nt, Artificial Sequence
  Description of Artificial Sequence: Synthetic oligonucleotide
uaauuuucaaaagggaau

SEQ ID NO: 162 - RNA, 18 nt, Artificial Sequence
  Description of Artificial Sequence: Synthetic oligonucleotide
caaggauuaaagguagca

SEQ ID NO: 163 - DNA, 18 bp, Artificial Sequence
  Description of Artificial Sequence: Synthetic oligonucleotide
cagagaaaatagtgttca

SEQ ID NO: 164 - DNA, 18 bp, Artificial Sequence
  Description of Artificial Sequence: Synthetic oligonucleotide
atattcagagaaaatagt

SEQ ID NO: 165 - DNA, 18 bp, Artificial Sequence
  Description of Artificial Sequence: Synthetic oligonucleotide
taaaaatattcagagaaa

SEQ ID NO: 166 - DNA, 18 bp, Artificial Sequence
  Description of Artificial Sequence: Synthetic oligonucleotide
aacaataaaaatattcag

SEQ ID NO: 167 - DNA, 18 bp, Artificial Sequence
  Description of Artificial Sequence: Synthetic oligonucleotide
ttccaaacaataaaaata

SEQ ID NO: 168 - DNA, 18 bp, Artificial Sequence
  Description of Artificial Sequence: Synthetic oligonucleotide
tattattccaaacaataa

SEQ ID NO: 169 - DNA, 18 bp, Artificial Sequence
  Description of Artificial Sequence: Synthetic oligonucleotide
tttgttattattccaaac

SEQ ID NO: 170 - DNA, 18 bp, Artificial Sequence
  Description of Artificial Sequence: Synthetic oligonucleotide
attattttgttattattc

SEQ ID NO: 171 - DNA, 18 bp, Artificial Sequence
  Description of Artificial Sequence: Synthetic oligonucleotide
atgtcattattttgttat

SEQ ID NO: 172 - DNA, 18 bp, Artificial Sequence
  Description of Artificial Sequence: Synthetic oligonucleotide
gatgtatgtcattatttt

SEQ ID NO: 173 - DNA, 18 bp, Artificial Sequence
  Description of Artificial Sequence: Synthetic oligonucleotide
taatagatgtatgtcatt

SEQ ID NO: 174 - DNA, 18 bp, Artificial Sequence
  Description of Artificial Sequence: Synthetic oligonucleotide
ctaaataatagatgtatg

SEQ ID NO: 175 - DNA, 18 bp, Artificial Sequence
  Description of Artificial Sequence: Synthetic oligonucleotide
aggaactaaataatagat

SEQ ID NO: 176 - DNA, 18 bp, Artificial Sequence
  Description of Artificial Sequence: Synthetic oligonucleotide
ttcttaggaactaaataa

SEQ ID NO: 177 - DNA, 18 bp, Artificial Sequence
  Description of Artificial Sequence: Synthetic oligonucleotide
actttttcttaggaacta

SEQ ID NO: 178 - DNA, 18 bp, Artificial Sequence
  Description of Artificial Sequence: Synthetic oligonucleotide
tatatactttttcttagg

SEQ ID NO: 179 - DNA, 18 bp, Artificial Sequence
  Description of Artificial Sequence: Synthetic oligonucleotide
tgcatgttttactttgga

SEQ ID NO: 180 - DNA, 18 bp, Artificial Sequence
  Description of Artificial Sequence: Synthetic oligonucleotide
gttttactttggagtaaa

SEQ ID NO: 181 - DNA, 18 bp, Artificial Sequence
  Description of Artificial Sequence: Synthetic oligonucleotide
actttggagtaaaaataa

SEQ ID NO: 182 - DNA, 18 bp, Artificial Sequence
  Description of Artificial Sequence: Synthetic oligonucleotide
ggagtaaaaataatttag

SEQ ID NO: 183 - DNA, 18 bp, Artificial Sequence
  Description of Artificial Sequence: Synthetic oligonucleotide
aaaaataatttagacctg

SEQ ID NO: 184 - DNA, 18 bp, Artificial Sequence
  Description of Artificial Sequence: Synthetic oligonucleotide
taatttagacctgatgtt

SEQ ID NO: 185 - DNA, 18 bp, Artificial Sequence
  Description of Artificial Sequence: Synthetic oligonucleotide
tagacctgatgtttaata

SEQ ID NO: 186 - DNA, 18 bp, Artificial Sequence
  Description of Artificial Sequence: Synthetic oligonucleotide
ctgatgtttaataaatat

SEQ ID NO: 187 - DNA, 18 bp, Artificial Sequence
  Description of Artificial Sequence: Synthetic oligonucleotide
gtttaataaatattctta

SEQ ID NO: 188 - DNA, 18 bp, Artificial Sequence
  Description of Artificial Sequence: Synthetic oligonucleotide
ataaatattcttactgat

SEQ ID NO: 189 - DNA, 18 bp, Artificial Sequence
  Description of Artificial Sequence: Synthetic oligonucleotide
tattcttactgatataat

SEQ ID NO: 190 - DNA, 18 bp, Artificial Sequence
  Description of Artificial Sequence: Synthetic oligonucleotide
ttactgatataattttca

SEQ ID NO: 191 - DNA, 18 bp, Artificial Sequence
  Description of Artificial Sequence: Synthetic oligonucleotide
gatataattttcaaaagg

SEQ ID NO: 192 - DNA, 18 bp, Artificial Sequence
  Description of Artificial Sequence: Synthetic oligonucleotide
aattttcaaaagggaata

SEQ ID NO: 193 - DNA, 18 bp, Artificial Sequence
  Description of Artificial Sequence: Synthetic oligonucleotide
ctttggagtaaaaataat

SEQ ID NO: 194 - DNA, 18 bp, Artificial Sequence
  Description of Artificial Sequence: Synthetic oligonucleotide
tttggagtaaaaataatt

SEQ ID NO: 195 - DNA, 18 bp, Artificial Sequence
  Description of Artificial Sequence: Synthetic oligonucleotide
ttggagtaaaaataattt

SEQ ID NO: 196 - DNA, 18 bp, Artificial Sequence
  Description of Artificial Sequence: Synthetic oligonucleotide
tggagtaaaaataattta

SEQ ID NO: 197 - DNA, 18 bp, Artificial Sequence
  Description of Artificial Sequence: Synthetic oligonucleotide
gagtaaaaataatttaga

SEQ ID NO: 198 - DNA, 18 bp, Artificial Sequence
  Description of Artificial Sequence: Synthetic oligonucleotide
agtaaaaataatttagac

SEQ ID NO: 199 - DNA, 18 bp, Artificial Sequence
  Description of Artificial Sequence: Synthetic oligonucleotide
gtaaaaataatttagacc

SEQ ID NO: 200 - DNA, 18 bp, Artificial Sequence
  Description of Artificial Sequence: Synthetic oligonucleotide
taaaaataatttagacct

SEQ ID NO: 201 - DNA, 18 bp, Artificial Sequence
  Description of Artificial Sequence: Synthetic oligonucleotide
tactgatataattttcaa

SEQ ID NO: 202 - DNA, 18 bp, Artificial Sequence
  Description of Artificial Sequence: Synthetic oligonucleotide
actgatataattttcaaa

SEQ ID NO: 203 - DNA, 18 bp, Artificial Sequence
  Description of Artificial Sequence: Synthetic oligonucleotide
ctgatataattttcaaaa

SEQ ID NO: 204 - DNA, 18 bp, Artificial Sequence
  Description of Artificial Sequence: Synthetic oligonucleotide
tgatataattttcaaaag

SEQ ID NO: 205 - DNA, 18 bp, Artificial Sequence
  Description of Artificial Sequence: Synthetic oligonucleotide
atataattttcaaaaggg

SEQ ID NO: 206 - DNA, 18 bp, Artificial Sequence
  Description of Artificial Sequence: Synthetic oligonucleotide
tataattttcaaaaggga

SEQ ID NO: 207 - DNA, 18 bp, Artificial Sequence
  Description of Artificial Sequence: Synthetic oligonucleotide
ataattttcaaaagggaa

SEQ ID NO: 208 - DNA, 18 bp, Artificial Sequence
  Description of Artificial Sequence: Synthetic oligonucleotide
taattttcaaaagggaat

SEQ ID NO: 209 - DNA, 18 bp, Artificial Sequence
  Description of Artificial Sequence: Synthetic oligonucleotide
caaggattaaaggtagca

SEQ ID NO: 210 - RNA, 18 nt, Artificial Sequence
  Description of Artificial Sequence: Synthetic oligonucleotide
gaugcucuccgucuguuu

SEQ ID NO: 211 - RNA, 18 nt, Artificial Sequence
  Description of Artificial Sequence: Synthetic oligonucleotide
uucaugaugcucuccguc

SEQ ID NO: 212 - RNA, 18 nt, Artificial Sequence
  Description of Artificial Sequence: Synthetic oligonucleotide
uuuuguucaugaugcucu

SEQ ID NO: 213 - RNA, 18 nt, Artificial Sequence
  Description of Artificial Sequence: Synthetic oligonucleotide
uuacuuuuuguucaugau

SEQ ID NO: 214 - RNA, 18 nt, Artificial Sequence
  Description of Artificial Sequence: Synthetic oligonucleotide
ugguguuacuuuuuguuc

SEQ ID NO: 215 - RNA, 18 nt, Artificial Sequence
  Description of Artificial Sequence: Synthetic oligonucleotide
acauuugguguuacuuuu

SEQ ID NO: 216 - RNA, 18 nt, Artificial Sequence
  Description of Artificial Sequence: Synthetic oligonucleotide
acagaacauuugguguua

SEQ ID NO: 217 - RNA, 18 nt, Artificial Sequence
  Description of Artificial Sequence: Synthetic oligonucleotide
auaugacagaacauuugg

SEQ ID NO: 218 - RNA, 18 nt, Artificial Sequence
  Description of Artificial Sequence: Synthetic oligonucleotide
aucugauaugacagaaca

SEQ ID NO: 219 - RNA, 18 nt, Artificial Sequence
  Description of Artificial Sequence: Synthetic oligonucleotide
uagaaaucugauaugaca

SEQ ID NO: 220 - RNA, 18 nt, Artificial Sequence
  Description of Artificial Sequence: Synthetic oligonucleotide
uuaguuagaaaucugaua

SEQ ID NO: 221 - RNA, 18 nt, Artificial Sequence
  Description of Artificial Sequence: Synthetic oligonucleotide
uguuauuaguuagaaauc

SEQ ID NO: 222 - RNA, 18 nt, Artificial Sequence
  Description of Artificial Sequence: Synthetic oligonucleotide
uaguuuguuauuaguuag

SEQ ID NO: 223 - RNA, 18 nt, Artificial Sequence
  Description of Artificial Sequence: Synthetic oligonucleotide
auauauaguuuguuauua

SEQ ID NO: 224 - RNA, 18 nt, Artificial Sequence
  Description of Artificial Sequence: Synthetic oligonucleotide
uagaaauauauaguuugu

SEQ ID NO: 225 - RNA, 18 nt, Artificial Sequence
  Description of Artificial Sequence: Synthetic oligonucleotide
caaaauagaaauauauag

SEQ ID NO: 226 - RNA, 18 nt, Artificial Sequence
  Description of Artificial Sequence: Synthetic oligonucleotide
auacaaaauagaaauaua

SEQ ID NO: 227 - RNA, 18 nt, Artificial Sequence
  Description of Artificial Sequence: Synthetic oligonucleotide
cuauacaaaauagaaaua

SEQ ID NO: 228 - RNA, 18 nt, Artificial Sequence
  Description of Artificial Sequence: Synthetic oligonucleotide
uccuauacaaaauagaaa

SEQ ID NO: 229 - RNA, 18 nt, Artificial Sequence
  Description of Artificial Sequence: Synthetic oligonucleotide
uauccuauacaaaauaga

SEQ ID NO: 230 - RNA, 18 nt, Artificial Sequence
  Description of Artificial Sequence: Synthetic oligonucleotide
auuauccuauacaaaaua

SEQ ID NO: 231 - RNA, 18 nt, Artificial Sequence
  Description of Artificial Sequence: Synthetic oligonucleotide
aguuggagcaagauuauc

SEQ ID NO: 232 - RNA, 18 nt, Artificial Sequence
  Description of Artificial Sequence: Synthetic oligonucleotide
auccaaguuggagcaaga

SEQ ID NO: 233 - RNA, 18 nt, Artificial Sequence
  Description of Artificial Sequence: Synthetic oligonucleotide
accccauccaaguuggag

SEQ ID NO: 234 - RNA, 18 nt, Artificial Sequence
  Description of Artificial Sequence: Synthetic oligonucleotide
gcuccaccccauccaagu

SEQ ID NO: 235 - RNA, 18 nt, Artificial Sequence
  Description of Artificial Sequence: Synthetic oligonucleotide
ccagcgcuccaccccauc

SEQ ID NO: 236 - RNA, 18 nt, Artificial Sequence
  Description of Artificial Sequence: Synthetic oligonucleotide
gaaccagcgcuccacccc

SEQ ID NO: 237 - RNA, 18 nt, Artificial Sequence
  Description of Artificial Sequence: Synthetic oligonucleotide
gggaggaaccagcgcucc

SEQ ID NO: 238 - RNA, 18 nt, Artificial Sequence
  Description of Artificial Sequence: Synthetic oligonucleotide
auaauaaagggcucaggg

SEQ ID NO: 239 - RNA, 18 nt, Artificial Sequence
  Description of Artificial Sequence: Synthetic oligonucleotide
ccauaauaaagggcucag

SEQ ID NO: 240 - RNA, 18 nt, Artificial Sequence
  Description of Artificial Sequence: Synthetic oligonucleotide
guaauacaguacccauaa

SEQ ID NO: 241 - RNA, 18 nt, Artificial Sequence
  Description of Artificial Sequence: Synthetic oligonucleotide
ggguaauacaguacccau

SEQ ID NO: 242 - RNA, 18 nt, Artificial Sequence
  Description of Artificial Sequence: Synthetic oligonucleotide
uuaaagguagcaaaaggg

SEQ ID NO: 243 - RNA, 18 nt, Artificial Sequence
  Description of Artificial Sequence: Synthetic oligonucleotide
aaggauuaaagguagcaa

SEQ ID NO: 244 - RNA, 18 nt, Artificial Sequence
  Description of Artificial Sequence: Synthetic oligonucleotide
agugcaaggauuaaaggu

SEQ ID NO: 245 - RNA, 18 nt, Artificial Sequence
  Description of Artificial Sequence: Synthetic oligonucleotide
gucacagugcaaggauua

SEQ ID NO: 246 - RNA, 18 nt, Artificial Sequence
  Description of Artificial Sequence: Synthetic oligonucleotide
cauaagucacagugcaag

SEQ ID NO: 247 - RNA, 18 nt, Artificial Sequence
  Description of Artificial Sequence: Synthetic oligonucleotide
cuacacauaagucacagu

SEQ ID NO: 248 - RNA, 18 nt, Artificial Sequence
  Description of Artificial Sequence: Synthetic oligonucleotide
ccccacuacacauaaguc

SEQ ID NO: 249 - RNA, 18 nt, Artificial Sequence
  Description of Artificial Sequence: Synthetic oligonucleotide
ccucaccccacuacacau

SEQ ID NO: 250 - RNA, 18 nt, Artificial Sequence
  Description of Artificial Sequence: Synthetic oligonucleotide
cccucccucaccccacua

SEQ ID NO: 251 - RNA, 18 nt, Artificial Sequence
  Description of Artificial Sequence: Synthetic oligonucleotide
ccaaucccucccucaccc

SEQ ID NO: 252 - RNA, 18 nt, Artificial Sequence
  Description of Artificial Sequence: Synthetic oligonucleotide
ccuucccaaucccucccu

SEQ ID NO: 253 - RNA, 18 nt, Artificial Sequence
  Description of Artificial Sequence: Synthetic oligonucleotide
aguacccuucccaauccc

SEQ ID NO: 254 - RNA, 18 nt, Artificial Sequence
  Description of Artificial Sequence: Synthetic oligonucleotide
auaauaguacccuuccca

SEQ ID NO: 255 - RNA, 18 nt, Artificial Sequence
  Description of Artificial Sequence: Synthetic oligonucleotide
gugcaauaauaguacccu

SEQ ID NO: 256 - RNA, 18 nt, Artificial Sequence
  Description of Artificial Sequence: Synthetic oligonucleotide
cuguggugcaauaauagu

SEQ ID NO: 257 - RNA, 18 nt, Artificial Sequence
  Description of Artificial Sequence: Synthetic oligonucleotide
gaugcucacugccuguuu

SEQ ID NO: 258 - RNA, 18 nt, Artificial Sequence
  Description of Artificial Sequence: Synthetic oligonucleotide
uauaugaugcucacugcc

SEQ ID NO: 259 - RNA, 18 nt, Artificial Sequence
  Description of Artificial Sequence: Synthetic oligonucleotide
uuuuguauaugaugcuca

SEQ ID NO: 260 - RNA, 18 nt, Artificial Sequence
  Description of Artificial Sequence: Synthetic oligonucleotide
uuacuuuuuguauaugau

SEQ ID NO: 261 - RNA, 18 nt, Artificial Sequence
  Description of Artificial Sequence: Synthetic oligonucleotide
ugguguuacuuuuuguau

SEQ ID NO: 262 - RNA, 18 nt, Artificial Sequence
  Description of Artificial Sequence: Synthetic oligonucleotide
acauuugguguuacuuuu

SEQ ID NO: 263 - RNA, 18 nt, Artificial Sequence
  Description of Artificial Sequence: Synthetic oligonucleotide
acagaacauuugguguua

SEQ ID NO: 264 - RNA, 18 nt, Artificial Sequence
  Description of Artificial Sequence: Synthetic oligonucleotide
auaugacagaacauuugg

SEQ ID NO: 265 - RNA, 18 nt, Artificial Sequence
  Description of Artificial Sequence: Synthetic oligonucleotide
agcugauaugacagaaca

SEQ ID NO: 266 - RNA, 18 nt, Artificial Sequence
  Description of Artificial Sequence: Synthetic oligonucleotide
uagaaagcugauaugaca

SEQ ID NO: 267 - RNA, 18 nt, Artificial Sequence
  Description of Artificial Sequence: Synthetic oligonucleotide
uuaguuagaaagcugaua

SEQ ID NO: 268 - RNA, 18 nt, Artificial Sequence
  Description of Artificial Sequence: Synthetic oligonucleotide
uauuauuaguuagaaagc

SEQ ID NO: 269 - RNA, 18 nt, Artificial Sequence
  Description of Artificial Sequence: Synthetic oligonucleotide
uaguuuauuauuaguuag

SEQ ID NO: 270 - RNA, 18 nt, Artificial Sequence
  Description of Artificial Sequence: Synthetic oligonucleotide
auauauaguuuauuauua

SEQ ID NO: 271 - RNA, 18 nt, Artificial Sequence
  Description of Artificial Sequence: Synthetic oligonucleotide
uagaaauauauaguuuau

SEQ ID NO: 272 - RNA, 18 nt, Artificial Sequence
  Description of Artificial Sequence: Synthetic oligonucleotide
uaaaauagaaauauauag

SEQ ID NO: 273 - RNA, 18 nt, Artificial Sequence
  Description of Artificial Sequence: Synthetic oligonucleotide
auauaaaauagaaauaua

SEQ ID NO: 274 - RNA, 18 nt, Artificial Sequence
  Description of Artificial Sequence: Synthetic oligonucleotide
cuauauaaaauagaaaua

SEQ ID NO: 275 - RNA, 18 nt, Artificial Sequence
  Description of Artificial Sequence: Synthetic oligonucleotide
uccuauauaaaauagaaa

SEQ ID NO: 276 - RNA, 18 nt, Artificial Sequence
  Description of Artificial Sequence: Synthetic oligonucleotide
uauccuauauaaaauaga

SEQ ID NO: 277 - RNA, 18 nt, Artificial Sequence
  Description of Artificial Sequence: Synthetic oligonucleotide
auuauccuauauaaaaua

SEQ ID NO: 278 - RNA, 18 nt, Artificial Sequence
  Description of Artificial Sequence: Synthetic oligonucleotide
aguuggagcaagauuauc

SEQ ID NO: 279 - RNA, 18 nt, Artificial Sequence
  Description of Artificial Sequence: Synthetic oligonucleotide
auccaaguuggagcaaga

SEQ ID NO: 280 - RNA, 18 nt, Artificial Sequence
  Description of Artificial Sequence: Synthetic oligonucleotide
accccauccaaguuggag

SEQ ID NO: 281 - RNA, 18 nt, Artificial Sequence
  Description of Artificial Sequence: Synthetic oligonucleotide
gcuccaccccauccaagu

SEQ ID NO: 282 - RNA, 18 nt, Artificial Sequence
  Description of Artificial Sequence: Synthetic oligonucleotide
ccaccgcuccaccccauc

SEQ ID NO: 283 - RNA, 18 nt, Artificial Sequence
  Description of Artificial Sequence: Synthetic oligonucleotide
gaaccaccgcuccacccc

SEQ ID NO: 284 - RNA, 18 nt, Artificial Sequence
  Description of Artificial Sequence: Synthetic oligonucleotide
gggaggaaccaccgcucc

SEQ ID NO: 285 - RNA, 18 nt, Artificial Sequence
  Description of Artificial Sequence: Synthetic oligonucleotide
auaauaaagggcugaggg

SEQ ID NO: 286 - RNA, 18 nt, Artificial Sequence
  Description of Artificial Sequence: Synthetic oligonucleotide
ccauaauaaagggcugag

SEQ ID NO: 287 - RNA, 18 nt, Artificial Sequence
  Description of Artificial Sequence: Synthetic oligonucleotide
guaauacaguacccauaa

SEQ ID NO: 288 - RNA, 18 nt, Artificial Sequence
  Description of Artificial Sequence: Synthetic oligonucleotide
ggguaauacaguacccau

SEQ ID NO: 289 - RNA, 18 nt, Artificial Sequence
  Description of Artificial Sequence: Synthetic oligonucleotide
uuaaagguagcaaaaggg

SEQ ID NO: 290 - RNA, 18 nt, Artificial Sequence
  Description of Artificial Sequence: Synthetic oligonucleotide
aaggauuaaagguagcaa

SEQ ID NO: 291 - RNA, 18 nt, Artificial Sequence
  Description of Artificial Sequence: Synthetic oligonucleotide
agugcaaggauuaaaggu

SEQ ID NO: 292 - RNA, 18 nt, Artificial Sequence
  Description of Artificial Sequence: Synthetic oligonucleotide
gucacagugcaaggauua

SEQ ID NO: 293 - RNA, 18 nt, Artificial Sequence
  Description of Artificial Sequence: Synthetic oligonucleotide
cauaagucacagugcaag

SEQ ID NO: 294 - RNA, 18 nt, Artificial Sequence
  Description of Artificial Sequence: Synthetic oligonucleotide
cuacacauaagucacagu

SEQ ID NO: 295 - RNA, 18 nt, Artificial Sequence
  Description of Artificial Sequence: Synthetic oligonucleotide
ucccacuacacauaaguc

SEQ ID NO: 296 - RNA, 18 nt, Artificial Sequence
  Description of Artificial Sequence: Synthetic oligonucleotide
cucaaucccacuacacau

SEQ ID NO: 297 - RNA, 18 nt, Artificial Sequence
  Description of Artificial Sequence: Synthetic oligonucleotide
ccucccucaaucccacua

SEQ ID NO: 298 - RNA, 18 nt, Artificial Sequence
  Description of Artificial Sequence: Synthetic oligonucleotide
cacucccucccucaaucc

SEQ ID NO: 299 - RNA, 18 nt, Artificial Sequence
  Description of Artificial Sequence: Synthetic oligonucleotide
cuucccacucccucccuc

SEQ ID NO: 300 - RNA, 18 nt, Artificial Sequence
  Description of Artificial Sequence: Synthetic oligonucleotide
guacccuucccacucccu

SEQ ID NO: 301 - RNA, 18 nt, Artificial Sequence
  Description of Artificial Sequence: Synthetic oligonucleotide
caauuguacccuucccac

SEQ ID NO: 302 - RNA, 18 nt, Artificial Sequence
  Description of Artificial Sequence: Synthetic oligonucleotide
uggugcaauuguacccuu

SEQ ID NO: 303 - RNA, 18 nt, Artificial Sequence
  Description of Artificial Sequence: Synthetic oligonucleotide
uacuguggugcaauugua

SEQ ID NO: 304 - DNA, 16 bp, Artificial Sequence
  Description of Artificial Sequence: Synthetic oligonucleotide
ttggagcaagattatc

SEQ ID NO: 305 - DNA, 17 bp, Artificial Sequence
  Description of Artificial Sequence: Synthetic oligonucleotide
gttggagcaagattatc

SEQ ID NO: 306 - DNA, 16 bp, Artificial Sequence
  Description of Artificial Sequence: Synthetic oligonucleotide
gttggagcaagattat

SEQ ID NO: 307 - DNA, 17 bp, Artificial Sequence
  Description of Artificial Sequence: Synthetic oligonucleotide
agttggagcaagattat

SEQ ID NO: 308 - DNA, 16 bp, Artificial Sequence
  Description of Artificial Sequence: Synthetic oligonucleotide
agttggagcaagatta

SEQ ID NO: 309 - DNA, 18 bp, Artificial Sequence
  Description of Artificial Sequence: Synthetic oligonucleotide
gattatcctatacaaaat

SEQ ID NO: 310 - DNA, 18 bp, Artificial Sequence
  Description of Artificial Sequence: Synthetic oligonucleotide
agattatcctatacaaaa

SEQ ID NO: 311 - DNA, 18 bp, Artificial Sequence
  Description of Artificial Sequence: Synthetic oligonucleotide
aagattatcctatacaaa

SEQ ID NO: 312 - DNA, 18 bp, Artificial Sequence
  Description of Artificial Sequence: Synthetic oligonucleotide
caagattatcctatacaa

SEQ ID NO: 313 - DNA, 18 bp, Artificial Sequence
  Description of Artificial Sequence: Synthetic oligonucleotide
gcaagattatcctataca

SEQ ID NO: 314 - DNA, 18 bp, Artificial Sequence
  Description of Artificial Sequence: Synthetic oligonucleotide
agcaagattatcctatac

SEQ ID NO: 315 - DNA, 18 bp, Artificial Sequence
  Description of Artificial Sequence: Synthetic oligonucleotide
gagcaagattatcctata

SEQ ID NO: 316 - DNA, 18 bp, Artificial Sequence
  Description of Artificial Sequence: Synthetic oligonucleotide
ggagcaagattatcctat

SEQ ID NO: 317 - DNA, 18 bp, Artificial Sequence
  Description of Artificial Sequence: Synthetic oligonucleotide
tggagcaagattatccta

SEQ ID NO: 318 - DNA, 18 bp, Artificial Sequence
  Description of Artificial Sequence: Synthetic oligonucleotide
gttggagcaagattatcc

SEQ ID NO: 319 - DNA, 18 bp, Artificial Sequence
  Description of Artificial Sequence: Synthetic oligonucleotide
ttggagcaagattatcct

SEQ ID NO: 320 - DNA, 18 bp, Artificial Sequence
  Description of Artificial Sequence: Synthetic oligonucleotide
aagttggagcaagattat

SEQ ID NO: 321 - DNA, 18 bp, Artificial Sequence
  Description of Artificial Sequence: Synthetic oligonucleotide
caagttggagcaagatta

SEQ ID NO: 322 - DNA, 18 bp, Artificial Sequence
  Description of Artificial Sequence: Synthetic oligonucleotide
ccaagttggagcaagatt

SEQ ID NO: 323 - DNA, 18 bp, Artificial Sequence
  Description of Artificial Sequence: Synthetic oligonucleotide
tccaagttggagcaagat

SEQ ID NO: 324 - DNA, 18 bp, Artificial Sequence
  Description of Artificial Sequence: Synthetic oligonucleotide
agtacccataataaaggg

SEQ ID NO: 325 - DNA, 18 bp, Artificial Sequence
  Description of Artificial Sequence: Synthetic oligonucleotide
aatacagtacccataata

SEQ ID NO: 326 - DNA, 18 bp, Artificial Sequence
  Description of Artificial Sequence: Synthetic oligonucleotide
attaaaggtagcaaaagg

SEQ ID NO: 327 - DNA, 18 bp, Artificial Sequence
  Description of Artificial Sequence: Synthetic oligonucleotide
gattaaaggtagcaaaag

SEQ ID NO: 328 - DNA, 18 bp, Artificial Sequence
  Description of Artificial Sequence: Synthetic oligonucleotide
ggattaaaggtagcaaaa

SEQ ID NO: 329 - DNA, 18 bp, Artificial Sequence
  Description of Artificial Sequence: Synthetic oligonucleotide
aggattaaaggtagcaaa

SEQ ID NO: 330 - DNA, 18 bp, Artificial Sequence
  Description of Artificial Sequence: Synthetic oligonucleotide
caaggattaaaggtagca

SEQ ID NO: 331 - DNA, 18 bp, Artificial Sequence
  Description of Artificial Sequence: Synthetic oligonucleotide
gcaaggattaaaggtagc

SEQ ID NO: 332 - DNA, 18 bp, Artificial Sequence
  Description of Artificial Sequence: Synthetic oligonucleotide
tgcaaggattaaaggtag

SEQ ID NO: 333 - DNA, 18 bp, Artificial Sequence
  Description of Artificial Sequence: Synthetic oligonucleotide
gtgcaaggattaaaggta

SEQ ID NO: 334 - DNA, 18 bp, Artificial Sequence
  Description of Artificial Sequence: Synthetic oligonucleotide
agtcacagtgcaaggatt

SEQ ID NO: 335 - DNA, 18 bp, Artificial Sequence
  Description of Artificial Sequence: Synthetic oligonucleotide
aagtcacagtgcaaggat

SEQ ID NO: 336 - DNA, 18 bp, Artificial Sequence
  Description of Artificial Sequence: Synthetic oligonucleotide
taagtcacagtgcaagga

SEQ ID NO: 337 - DNA, 18 bp, Artificial Sequence
  Description of Artificial Sequence: Synthetic oligonucleotide
ataagtcacagtgcaagg

SEQ ID NO: 338 - DNA, 18 bp, Artificial Sequence
  Description of Artificial Sequence: Synthetic oligonucleotide
acataagtcacagtgcaa

SEQ ID NO: 339 - DNA, 18 bp, Artificial Sequence
  Description of Artificial Sequence: Synthetic oligonucleotide
cacataagtcacagtgca

SEQ ID NO: 340 - DNA, 18 bp, Artificial Sequence
  Description of Artificial Sequence: Synthetic oligonucleotide
acacataagtcacagtgc

SEQ ID NO: 341 - DNA, 18 bp, Artificial Sequence
  Description of Artificial Sequence: Synthetic oligonucleotide
tacacataagtcacagtg

SEQ ID NO: 342 - RNA, 16 nt, Artificial Sequence
  Description of Artificial Sequence: Synthetic oligonucleotide
uuggagcaagauuauc

SEQ ID NO: 343 - RNA, 17 nt, Artificial Sequence
  Description of Artificial Sequence: Synthetic oligonucleotide
guuggagcaagauuauc

SEQ ID NO: 344 - RNA, 16 nt, Artificial Sequence
  Description of Artificial Sequence: Synthetic oligonucleotide
guuggagcaagauuau

SEQ ID NO: 345 - RNA, 17 nt, Artificial Sequence
  Description of Artificial Sequence: Synthetic oligonucleotide
aguuggagcaagauuau

SEQ ID NO: 346 - RNA, 16 nt, Artificial Sequence
  Description of Artificial Sequence: Synthetic oligonucleotide
aguuggagcaagauua

SEQ ID NO: 347 - RNA, 18 nt, Artificial Sequence
  Description of Artificial Sequence: Synthetic oligonucleotide
gauuauccuauacaaaau

SEQ ID NO: 348 - RNA, 18 nt, Artificial Sequence
  Description of Artificial Sequence: Synthetic oligonucleotide
agauuauccuauacaaaa

SEQ ID NO: 349 - RNA, 18 nt, Artificial Sequence
  Description of Artificial Sequence: Synthetic oligonucleotide
aagauuauccuauacaaa

SEQ ID NO: 350 - RNA, 18 nt, Artificial Sequence
  Description of Artificial Sequence: Synthetic oligonucleotide
caagauuauccuauacaa

SEQ ID NO: 351 - RNA, 18 nt, Artificial Sequence
  Description of Artificial Sequence: Synthetic oligonucleotide
gcaagauuauccuauaca

SEQ ID NO: 352 - RNA, 18 nt, Artificial Sequence
  Description of Artificial Sequence: Synthetic oligonucleotide
agcaagauuauccuauac

SEQ ID NO: 353 - RNA, 18 nt, Artificial Sequence
  Description of Artificial Sequence: Synthetic oligonucleotide
gagcaagauuauccuaua

SEQ ID NO: 354 - RNA, 18 nt, Artificial Sequence
  Description of Artificial Sequence: Synthetic oligonucleotide
ggagcaagauuauccuau

SEQ ID NO: 355 - RNA, 18 nt, Artificial Sequence
  Description of Artificial Sequence: Synthetic oligonucleotide
uggagcaagauuauccua

SEQ ID NO: 356 - RNA, 18 nt, Artificial Sequence
  Description of Artificial Sequence: Synthetic oligonucleotide
guuggagcaagauuaucc

SEQ ID NO: 357 - RNA, 18 nt, Artificial Sequence
  Description of Artificial Sequence: Synthetic oligonucleotide
uuggagcaagauuauccu

SEQ ID NO: 358 - RNA, 18 nt, Artificial Sequence
  Description of Artificial Sequence: Synthetic oligonucleotide
aaguuggagcaagauuau

SEQ ID NO: 359 - RNA, 18 nt, Artificial Sequence
  Description of Artificial Sequence: Synthetic oligonucleotide
caaguuggagcaagauua

SEQ ID NO: 360 - RNA, 18 nt, Artificial Sequence
  Description of Artificial Sequence: Synthetic oligonucleotide
ccaaguuggagcaagauu

SEQ ID NO: 361 - RNA, 18 nt, Artificial Sequence
  Description of Artificial Sequence: Synthetic oligonucleotide
uccaaguuggagcaagau

SEQ ID NO: 362 - RNA, 18 nt, Artificial Sequence
  Description of Artificial Sequence: Synthetic oligonucleotide
aguacccauaauaaaggg

SEQ ID NO: 363 - RNA, 18 nt, Artificial Sequence
  Description of Artificial Sequence: Synthetic oligonucleotide
aauacaguacccauaaua

SEQ ID NO: 364 - RNA, 18 nt, Artificial Sequence
  Description of Artificial Sequence: Synthetic oligonucleotide
auuaaagguagcaaaagg

SEQ ID NO: 365 - RNA, 18 nt, Artificial Sequence
  Description of Artificial Sequence: Synthetic oligonucleotide
gauuaaagguagcaaaag

SEQ ID NO: 366 - RNA, 18 nt, Artificial Sequence
  Description of Artificial Sequence: Synthetic oligonucleotide
ggauuaaagguagcaaaa

SEQ ID NO: 367 - RNA, 18 nt, Artificial Sequence
  Description of Artificial Sequence: Synthetic oligonucleotide
aggauuaaagguagcaaa

SEQ ID NO: 368 - RNA, 18 nt, Artificial Sequence
  Description of Artificial Sequence: Synthetic oligonucleotide
caaggauuaaagguagca

SEQ ID NO: 369 - RNA, 18 nt, Artificial Sequence
  Description of Artificial Sequence: Synthetic oligonucleotide
gcaaggauuaaagguagc

SEQ ID NO: 370 - RNA, 18 nt, Artificial Sequence
  Description of Artificial Sequence: Synthetic oligonucleotide
ugcaaggauuaaagguag

SEQ ID NO: 371 - RNA, 18 nt, Artificial Sequence
  Description of Artificial Sequence: Synthetic oligonucleotide
gugcaaggauuaaaggua

SEQ ID NO: 372 - RNA, 18 nt, Artificial Sequence
  Description of Artificial Sequence: Synthetic oligonucleotide
agucacagugcaaggauu

SEQ ID NO: 373 - RNA, 18 nt, Artificial Sequence
  Description of Artificial Sequence: Synthetic oligonucleotide
aagucacagugcaaggau

SEQ ID NO: 374 - RNA, 18 nt, Artificial Sequence
  Description of Artificial Sequence: Synthetic oligonucleotide
uaagucacagugcaagga

SEQ ID NO: 375 - RNA, 18 nt, Artificial Sequence
  Description of Artificial Sequence: Synthetic oligonucleotide
auaagucacagugcaagg

SEQ ID NO: 376 - RNA, 18 nt, Artificial Sequence
  Description of Artificial Sequence: Synthetic oligonucleotide
acauaagucacagugcaa

SEQ ID NO: 377 - RNA, 18 nt, Artificial Sequence
  Description of Artificial Sequence: Synthetic oligonucleotide
cacauaagucacagugca

SEQ ID NO: 378 - RNA, 18 nt, Artificial Sequence
  Description of Artificial Sequence: Synthetic oligonucleotide
acacauaagucacagugc

SEQ ID NO: 379 - RNA, 18 nt, Artificial Sequence
  Description of Artificial Sequence: Synthetic oligonucleotide
uacacauaagucacagug

SEQ ID NO: 380 - DNA, 264 bp, Homo sapiens
ggaaacagacggagagcatcatgaacaaaaagtaacaccaaatgttctgtcatatcagatttctaactaataacaaactatatatttctattttgtataggataatcttgctccaacttggatggggtggagcgctggttcctcccctgagccctttattatgggtactgtattaccccttttgctacctttaatccttgcactgtgacttatgtgtagtggggtgagggagggattgggaagggtactattattgcaccacag

SEQ ID NO: 381 - DNA, 98 bp, Homo sapiens
aaacagacggagagcatcatgaacaaaaagtaacaccaaatgttctgtcatatcagatttctaactaataacaaactatatatttctattttgtatag

SEQ ID NO: 382 - DNA, 94 bp, Homo sapiens
tttctattttgtataggataatcttgctccaacttggatggggtggagcgctggttcctcccctgagccctttattatgggtactgtattaccc

SEQ ID NO: 383 - DNA, 100 bp, Homo sapiens
gtactgtattaccccttttgctacctttaatccttgcactgtgacttatgtgtagtggggtgagggagggattgggaagggtactattattgcaccacag

What is claimed is:

1. A pharmaceutical composition comprising an antisense oligomer that comprises a sequence selected from the group consisting of SEQ ID NOs: 21-61, 64-67, 210-250, 253-256 and 304-379, and a pharmaceutically acceptable excipient.

2. The pharmaceutical composition of claim 1, wherein the antisense oligomer comprises a sequence selected from the group consisting of SEQ ID NOs: 21-61 and 64-67.

3. The pharmaceutical composition of claim 1, wherein the antisense oligomer comprises a sequence selected from the group consisting of SEQ ID NOs: 210-250 and 253-256.

4. The pharmaceutical composition of claim 1, wherein the antisense oligomer comprises a sequence selected from the group consisting of SEQ ID NOs: 304-379.

5. The pharmaceutical composition of claim 1, wherein the antisense oligomer is a sequence selected from the group consisting of SEQ ID NOs: 21-61, 64-67, 210-250, 253-256, and 304-379.

6. The pharmaceutical composition of claim 1, wherein the antisense oligomer comprises a 2'-O-methoxyethyl moiety.

7. The pharmaceutical composition of claim 6, wherein each nucleotide of the antisense oligomer comprises a 2'-O-methoxyethyl moiety.

8. The pharmaceutical composition of claim 1, wherein the antisense oligomer consists of from 8 to 50 nucleobases.

9. The pharmaceutical composition of claim 1, wherein the antisense oligomer consists of from 12 to 20 nucleobases.

10. The pharmaceutical composition of claim 1, wherein the pharmaceutical composition is formulated for intrathecal injection or intracerebroventricular injection.

11. The pharmaceutical composition of claim 1, wherein the antisense oligomer comprises a backbone modification, a modified sugar moiety or a combination thereof.

12. A composition comprising a viral vector encoding an antisense oligomer; wherein the antisense oligomer binds to a targeted portion of a pre-mRNA that contains a non-sense mediated RNA decay-inducing exon (NMD exon mRNA) and that encodes Nav1.1 protein, whereby the antisense oligomer promotes exclusion of the NMD exon from the NMD exon mRNA encoding Nav1.1.

13. The composition of claim 12, wherein the antisense oligomer comprises a sequence selected from the group consisting of SEQ ID NOs: 21-67, 210-256 and 304-379.

14. The composition of claim 12, wherein the antisense oligomer comprises a sequence selected from the group consisting of SEQ ID NOs: 21-61, 64-67, 210-250, 253-256, and 304-379.

15. The composition of claim 12, wherein the antisense oligomer comprises a sequence selected from the group consisting of SEQ ID NOs: 32-35, 39, 40, 42-45, 49-51, 54-59, 66, 221-224, 228, 229, 231-234, 238-240, 243-248, 255, 304-308, 312-316, 318-324, 326-335, 337-346, 350-354, 356-362, 364-373 and 375-379.

16. The pharmaceutical composition of claim 1, wherein the antisense oligomer comprises a sequence selected from the group consisting of SEQ ID NOs: 32-35, 39, 40, 42-45, 49-51, 54-59, 66, 221-224, 228, 229, 231-234, 238-240, 243-248, 255, 304-308, 312-316, 318-324, 326-335, 337-346, 350-354, 356-362, 364-373 and 375-379.

17. The pharmaceutical composition of claim 1, wherein the antisense oligomer is SEQ ID NO: 32 or 221.

18. The pharmaceutical composition of claim 1, wherein the antisense oligomer is SEQ ID NO: 33 or 222.

19. The pharmaceutical composition of claim 1, wherein the antisense oligomer is SEQ ID NO: 42 or 231.

20. The pharmaceutical composition of claim 1, wherein the antisense oligomer is SEQ ID NO: 43 or 232.

21. The pharmaceutical composition of claim 1, wherein the antisense oligomer is SEQ ID NO: 44 or 233.

22. The pharmaceutical composition of claim 1, wherein the antisense oligomer is SEQ ID NO: 51 or 240.

23. The pharmaceutical composition of claim 1, wherein the antisense oligomer is SEQ ID NO: 54 or 243.

24. The pharmaceutical composition of claim 1, wherein the antisense oligomer is SEQ ID NO: 55 or 244.

25. The pharmaceutical composition of claim 1, wherein the antisense oligomer is SEQ ID NO: 56 or 245.

26. The pharmaceutical composition of claim 1, wherein the antisense oligomer is SEQ ID NO: 57 or 246.

27. The pharmaceutical composition of claim 1, wherein the antisense oligomer is SEQ ID NO: 58 or 247.

28. The pharmaceutical composition of claim 1, wherein the antisense oligomer is SEQ ID NO: 59 or 248.

29. The pharmaceutical composition of claim 1, wherein the antisense oligomer is SEQ ID NO: 304 or 342.

30. The pharmaceutical composition of claim 1, wherein the antisense oligomer is SEQ ID NO: 305 or 343.

31. The pharmaceutical composition of claim 1, wherein the antisense oligomer is SEQ ID NO: 306 or 344.

32. The pharmaceutical composition of claim 1, wherein the antisense oligomer is SEQ ID NO: 307 or 345.

33. The pharmaceutical composition of claim 1, wherein the antisense oligomer is SEQ ID NO: 308 or 346.

34. The pharmaceutical composition of claim 1, wherein the antisense oligomer is SEQ ID NO: 312 or 350.

35. The pharmaceutical composition of claim 1, wherein the antisense oligomer is SEQ ID NO: 313 or 351.

36. The pharmaceutical composition of claim 1, wherein the antisense oligomer is SEQ ID NO: 314 or 352.

37. The pharmaceutical composition of claim 1, wherein the antisense oligomer is SEQ ID NO: 315 or 353.

38. The pharmaceutical composition of claim 1, wherein the antisense oligomer is SEQ ID NO: 316 or 354.

39. The pharmaceutical composition of claim 1, wherein the antisense oligomer is SEQ ID NO: 318 or 356.

40. The pharmaceutical composition of claim 1, wherein the antisense oligomer is SEQ ID NO: 319 or 357.

41. The pharmaceutical composition of claim 1, wherein the antisense oligomer is SEQ ID NO: 320 or 358.

42. The pharmaceutical composition of claim 1, wherein the antisense oligomer is SEQ ID NO: 321 or 359.

43. The pharmaceutical composition of claim 1, wherein the antisense oligomer is SEQ ID NO: 322 or 360.

44. The pharmaceutical composition of claim 1, wherein the antisense oligomer is SEQ ID NO: 323 or 361.

45. The pharmaceutical composition of claim 1, wherein the antisense oligomer is SEQ ID NO: 324 or 362.

46. The pharmaceutical composition of claim 1, wherein the antisense oligomer is SEQ ID NO: 326 or 364.

47. The pharmaceutical composition of claim 1, wherein the antisense oligomer is SEQ ID NO: 327 or 365.

48. The pharmaceutical composition of claim 1, wherein the antisense oligomer is SEQ ID NO: 328 or 366.

49. The pharmaceutical composition of claim 1, wherein the antisense oligomer is SEQ ID NO: 329 or 367.

50. The pharmaceutical composition of claim 1, wherein the antisense oligomer is SEQ ID NO: 330 or 368.

51. The pharmaceutical composition of claim 1, wherein the antisense oligomer is SEQ ID NO: 331 or 369.

52. The pharmaceutical composition of claim 1, wherein the antisense oligomer is SEQ ID NO: 332 or 370.

53. The pharmaceutical composition of claim 1, wherein the antisense oligomer is SEQ ID NO: 333 or 371.

54. The pharmaceutical composition of claim 1, wherein the antisense oligomer is SEQ ID NO: 334 or 372.

55. The pharmaceutical composition of claim 1, wherein the antisense oligomer is SEQ ID NO: 335 or 373.

56. The pharmaceutical composition of claim 1, wherein the antisense oligomer is SEQ ID NO: 337 or 375.

57. The pharmaceutical composition of claim 1, wherein the antisense oligomer is SEQ ID NO: 338 or 376.

58. The pharmaceutical composition of claim 1, wherein the antisense oligomer is SEQ ID NO: 339 or 377.

59. The pharmaceutical composition of claim 1, wherein the antisense oligomer is SEQ ID NO: 340 or 378.

60. The pharmaceutical composition of claim 1, wherein the antisense oligomer is SEQ ID NO: 341 or 379.

61. The pharmaceutical composition of any one of claims 16-60, wherein the antisense oligomer comprises a 2'-O-methoxyethyl moiety.

62. The pharmaceutical composition of any one of claims 16-60, wherein each nucleotide of the antisense oligomer comprises a 2'-O-methoxyethyl moiety.

* * * * *